United States Patent 10,233,495 (METHODS AND COMPOSITIONS FOR SCREENING AND TREATING DEVELOPMENTAL DISORDERS) - sequence listing, part 53

SEQ ID NO: 507 - DNA, 33862096 bp, Homo sapiens (residues 19,047,430-21,163,810 of 33,862,096)
tccctgacgtcatctgctgatcataggtgttccagagctgctgctgtaacaggccatctttggggacagaagataaagctcagagacttagaaactggaccctcagagggtgaaccagaacaaacccaattcattcacctgttcttcatatgacatatttcccagatcttttaccacccctccccacctccacagacttcttttgggtaccttctggtttgtctcagtattcctcttaaggaataatggccataactggaaacagtgatgcggatatggctaaacttatacagaatagagtgggattattgccactgtcaattggtgtattaattatccactgttgaataacaaattactcccaaaacttagtggcttgaaataacatttatgatctcaccatttctgtgggtcaggaatccatacaacgtagctgggtcttctggctcagggcctctcacaaggtggaagtcaaggtgttggctgcagtggcagtcatctcaaggctcaactggggaaggacctgcctctgagttcattcatgtggttgtgagcaggactcagtttatcacaggctattggtctgggggcctcagttcgtcactggctgttggccagaggctgccttcaggtccttgccacatgggcctctctagagaacagctcacgacatagtagctcgcttcatcagagcaagcgaggaaagccagagagagagagagagagcaagcaagcaagacagaactcacagtcttttataaccaaatcacagaagtaatagcctatcacttttgccatattctatttgttagaagcatatcacttggtccagcccactcatacagagcgtggattacataaggcatgaataacaagaagcaaggatcatgaggagccatttcagaagcagcctatcacaactggacaccatgcttctgatcctgaacctaaaactatgacctaaaaagaaagcccgcatgaatgatttactttaagtgacctcaggttagtgaggcccctaagtatttggcaaaagcaaacaatcatcatctctgcaagaacttactttaagcccaggcaccaagtgcttgcacaaccacatgaaggtccaataaacataagttcacaatggaaaagaaaaaaacataagtcactatgagtgacagttagcagaaacaaaggaccatacctgcagatactatagacactggaattatcagatacacaatatataataagatgtttaatatgtagaattgaaaatacgactgaggaacaaaagggtttttaaaaatagcaaatcatttctgaaatgaaaacaatattgcttctcaactttttggctaagatcaagtaaaatgaaaccaaatataatttctagaaataaaaaataaaatagttgaaattagaaatcaatagcctggtggctgggcgtggtggctcatgcctgtaatcccagcactttgggaggccgaggcaggcagatcacttgaggtcaggaatttgagaccagcctggccaacatggcgaaacaccatctctactaaaaatacaaaaatttagccgggcgtggtggcacaagcctgtagtcccaactactcgggaggctgagacaggagaattgcttgaaccagggaggcagaggttgcagtgaaccaagattgcgccactgcactccagcctgggtgacagagtgagactctgtctcaaacaaaaaaaaaaaaaaagaaatcaatagcctggttaaaacagcggatcagacacagttgaagtgagaattaagaaactgaaagatagatttcaagaaattactcagaatgcagcaagggaaagacgtggaaattccaaagagagggcaaaaggcacagaaaatagagaaggttttatatataattggactttcaaaatgaaattaaagaacaagcaagagaatattcaaagagaatgacagctgggcaaggtggctcacatctgtaatcccagtactttgggaggccaaggcaggaggatcacttgagaccagcccgggcaacatagcaagaccctgtctctaaaaaaaaaaaaaaaaattaatcaattttttaaaaattagccaggcatggtggcatgtgcctgtacttctagctattcaggaggccaaggcaggaggattgcttgaacccaggagtttgaggctacaatgagctatgattgcaccactcccgcctgggtgacaatgtgagaccctgtctctgagaaagaaaaagaaaatggcagagaatttaccatacgtgatgcagacaacaaatcctaaaattcagaaactaaactgtactggttatttacctagctttcaactccacatccatccttctatttcctgcaaaataatgctaggatgggatgtcttcaaagcacttttccaggctctgttagtggctggcttcccccaaggtttcaccaataataggcactggtcagtaatcataaggtaggaaaggggaatagcagtagttcttcccctctcttttttggtcttttccttctggttctaaactctcagcaatagcacttcctccaaccattcagccccagtagcccaaccattgaggagatggtggtccctcctcttcccttctagattctggtaatgtaacttactctctttgattccttgagccctagagatgtgatagctactttctgtattttctaatctctgggctacctcacctttgttcctctttcaaccttttgacatatgtgtagctaattcccttacaaaatcctccacataaaaattgtatacaaaatacaaaaaaatgttttaaaatacctagcatggtttctttttcctgcctggactgtgactcaaataccaacaattccaatcagaaagaataaaaagaaatccacacctagacacatcgaagtcaaatttagatcatcagaaagaggacagattgcctaaaagaagtgactggtggattgatgatggacttaacagtaacagtggaagccaaaaaataagtaccattctcaaagtgctgaggaaaaacaactgtcagcctagaagtacatactctatgaaactatcatctcaaaataagcgggaaatcaagatatttttcagataaaactcaagtgttttccacaaactgagactctccaaagaaatttcttaaagatatacttccggaaaaagacaaattgtcccaaaagaaaggcctgaaatgttaccaggcaatggtgaggaaaaaaaaaaaaaaaaaaagaagcatccagttatctaaagaaatactgcctctaacaaacaacaaaaatatctttttatgtgcttaaataacatcaacagagaaccaaaataccagaaaaaaatgacacgaaagtcaggagtggggtaatgatcattaaagcttccaaaggtcctgatattattcaagagaatgctaagggtattgaccaattttagaccatgctgagttaaataatagagatgcaccaaagtttagtgcatctctattatttaactctaaactttggtgcatctctattatttagctcagcatggtctaaaagacctggccttgggatctggggtttagtttccccctcagccttgcctttagaaatccaattagccagatgcctactttgacatcatttctggcatccctgaaaagttgcacaaccagttatcatatgattgagtaggtactatcatatttaattagtgaaacaatgtctgtaatatgaataaggtatgccacttggatgaattgaaaatactttaatatttacttttgaatatacataaacatgctaagaataacttggagtgaaatttttctgtatgagctttctacgtttatatctatcacttgaatcaaaaaatgttattcattggttcagtatactcagtactgaagagtaaaatgctgcaataattatgatttttaatactattgacatagagaaccaattattaacaaccagcattgctcagcttttgctatgttatgctgcagcaacaaaccctaaaataaacaactatatttaattttgtgtttcttaattccacttaggccataagtcttacaagaaaaagtattactaggaaattcttcacatcttgcaagggtaaatttaaagcagaattttagctttgccaccttaaaatttcacaagcaggaaaaacccaaaaatcctgctcttaaggtgaaagcgaacatctatttatgtggtacataacactggcattaaggtcaggcacagtggctcacacctgtaaatcccagtactttgggaggccaaggtgggaggattgcttgagttgaggagtttgagaccagcctgggcaacaaagcgaggccctcatctctacaaaaacatttttaaaaaattagccagacatggtggcatgcacctgtggtcccagttacttcggaagctgagctgggaggatcacttccccagaaggttgaggctgaagtgagttgtgatagtgccactgcactccagcctgggcaacaaagcaagacactgtctcaaaaaaaataaaaaaataaaagataaaaaataaattaaaaaaaaacactgtgtgaaaagaaaataaatcttgggaccccaaaatcactaagccaaagggaaaagtcaagctgggaaatgcatcaggcaaacctgcctcccattttggtcctaaataagatagctacatagatgtttttttaaaaagctacatacctccctcataactggcccacaaggaatttccctaaaacagttctattgaattttaccttggtaatgtaaattgatagcttatcttcacaggtgcaggacaaaaaagacagaactcaaagtcatcctgcgactaacctaagacaaatgtttatctgattgcttcctttgtttttgttttttgtgttttgttttaagatggagttttgctcttttgcccaggctggagtgaagtggtgtgatctcggctcactgcaacctctgcctcccatcccacccccatgccaggttcaagcgattctcctgcctcagcctcccgagtagctgggattataggcacctgccaccatgcctggctaatttttgtatttttagtagagatggtgttttgccatgttggccagcctggtctcgaactcctgatctcaggtgatccacctgcctcggcctcccaaagtgctaggattacagccatgagccaccccacctggctggattgtttcctttgtttatgtaaaaatgcagtcactgaatcggactaaggcatgtgactatttctctaccccctgcaacgtgtaaatcgtgtattcagcaaaagactgatcaaagaccccagagaatgcagcctttagtctcttatctacctatgacctagaagccaccacttcgagttgtcccgcctttccggaccaaaccaatgtacatcttacacatactgattgctatttcatgtctccctaaaatatataaaaccaagctgtgcccaaccaccttaggcacgcgtcgtaaggacctcctgaggctgtgtcacaggtgcatccttaaccttgacaaaacaaactttctaagttaattgagacctgtctcagatacttttgggttcacaactgtttacttccaggcatgttcttctctacttccaggtatacaggggattacactttccctgccctttttagttaggcacagctacttgactagttttgataatgaaacatgaatagaagtaatatgtgaatatctgagctatagcatttcactgccagtggtagactccctagtccacttctttccctgccttggcgaaccctaagcatcatcttgtgatgtggacatgataaaatggtggagtctccatcagcctgctacccttctacctgcatgtcctgccaactagcacacacaaaaaataaatctttgttgttttaagccacttggattttagggttggtttccaaagcataagctaggttatactgactgttgcaaattaatgccataaatgtagactataatgatcccagaagcaaactatcagctcacactgatgagaaatacatatttctgaatgccatgtcaaactttaaaaatttaaatagcaatactttataattgaaaaataaaaattgtatatatttatcatgtacaacatgctattttgaaatatgcatacattgtgtaatgactaactgaatactaatattttcaataaaactaatataaacatttaatttttaatttttatatttcatgtattttttatcgctgaagtttattatatgatggtgatattctgcttcagccaaatagtgacttttaacatgcagctgctttgcattcagccaatatatgtatattccgtgcccctctaaaaataatatacatacaaatgatataaattaaatcttggttatgtgtcctttacttaaaatacatacttcacagaaacctgaaacaatttgtaaattaagtcacaaatttattctaaggaagaataccttgatcttctagaattcaggcattttttgctgccaccttgcatcctctatcttgtctcttctgctgccaccagctggcttccactactgctaaatttcagcagccagcaggattcaattcagtgctttgttttgactgctgagtccctgatgaaaacaccaagtcagttgaataactaaatttttaggctggaaacagaaaagcacaaccaacgcatttcctgtgtactttgggctatcagatagccacatggtagctggtacttgtcccagtaagtggtccagacaaggctgcgggctaacaaaagagaagacatttcggttcttaagttaatattctgctcccagagaagaatattgttaaaaactatagagtcattatataagaacagacaaaggtcagaacaaacacaatagtgtatccatagcctcagtatatggccaggcgtggtggctcacacctgtaatcccagtactttgggaggcagaagccggcagatcacctgaggtcaagaggtcgagaccagcctggccaacatggtgacaccttgtctctactaaaaatacaaaaattagctgggattggtggtatgtgcccataatcccagctactcaggaggctgaggcaggagaattgcttgagtccgggagaaggaggttgcagtgagccaagatcatccgactgcactccagcctgggcgacaggagtgagactacgtctcaaaaaagagaaaaagaagtctcagtatagtgttaagcttttaataacttcaggagtataaattatatgaactcatacattatttgaaagtaaaattatttaactgtattaactataaaattatttaactgcctatttggtttgtgaatttttgaacagaaaatgtgttttaattttttgtttcagtcaatgtttgccatcttccgttaaagggactaaaaaatttaaaaatgttcaaaattcacaaaataaaataaacatataagaaatttaaataaaccttcaagtgactttttgcaagttggtagcattaatacttcagaaattattaaagcttaaaacagcactaagtcttttgggatacttgtatatggaaaactgtggagtaacagggtgcttgaatacaaacttttataatttacacccagctatgtccaaagaaaacggaaataatttataacaacacatacacacacaaataggcaaagatatgtaaaacagtcataagctgtcttgaagctggagaaacatgtccctaagtgagtaaaactttaggaaaagcagggagaatgaggcaaattagtagcaatatttgtaatataggtttctggtattattgtatattttcacttggaagggggttgaggatacatttttatttgggatacttgttcttgagatagtattatgttctcaatattttggtattagcattattatagctaatgatgcttttccagaaaagttgaaacaaataacttttaaagatgcacataaatagaacgtaaaaaaaccccaataaatagttttcttttctcttagagattatctagttcagtggttctcaaccttggctgcacagtgcaatgacttgaggagcttaaaaagtataaatgcttgggtcccactgagcatctgatttaattggtcgaggatacagaacgggcatcgggaattttaaaagaccttggtgatcctaaagtgcaggtaaggttgagaactgctgctctagttcaatatataatcaggtatacattaacgttaaaatgtgtaggtgttcagagttctgatttttaaccatagcaccatctcaaatattataaaaggttgaaaaaagagcctaatttaatcaacatggataaatttcaaaaagcatgttgaacgatacaagccagacacaaagagtacttattgctttctatttacataaagttaaaaataatcagaacagggggaggggctactgactaggaagggacgcaagaaggaaattcctgagagggaaattttctccattttgattagggtacacgtatatatatatatatatatatttatcaaaactcacagaaatggacaattgagctctgtatgtatgatttcattacatgtaaatttacacttcagtaaaaaggataaacaattaaatctggatatctatgacagggtcggggagggagagattattacttcagacgaccccaaatcctcatgggttaaaagaaacagcaaacccctgaccagaactggcgagaatggagagtagacagcagggagggccaaagcctaagaaatcgctacaagactagatgccgagttcgaactactgcctggacggcagcgcccgagcgcccgcaaaaataagcccccgtgccatttccggtactagcaaatcctcctgtatgtccccactggaagagtccggtgggaaaccgtgccaccgcaaggaaggagccggcggtagcttggttcctgagcggatgctggggctgtaaggcgcgcgcggtcagctgttggcggtgcagggaggaggacgccggggctcgccttccctcctctgccgccgctgccgccatgattccggtgtcgctggtggtggtggtggtgggtggctggactgtcgtctacctgaccgacttggtgctgaaggtgagggccttgggcctaaggtccaagcccgcggtgcccatggccggagcgcaaggccttcttttctcttcccctgcctggcgcctcccgggctggacggtgcccacgtgcgacagtccgcgtggtggatcggcccggtggagtaaataaaacattgccggccgcgggagggttgtggcggcctgcgcggctgccactgtcgcagtgcggggcagtgcaggcccttcagccttcgggtcctgcccgggaggcgccagtggtgggatcgggagggccggggccctgccagacccagcagctgcagtgcagcagggaggaaaagaaaacgtctgcttagtaaagacagtgctttcccttattgtttttaagttcaaaacgctctagagactcagatattggaatgaatctaaatcaagtcgtgattgaaatcagtagtctcaaatttttaaatgcatatgatcatctggtttgcggtcaaaatgcagattccgattcagcaggtctgcggcaaggcctaaaattctgcatttctaaccagttcccaagtgctactgatgctgccagatcacagagtgtacttcaaagtagcacactcaaatagcaaggatttacataaccagtttctaactacttgaattctgatttacacgctgcaccccacttcttcacactaaccagataccctgggtgcacggtccattttccagttatttgagaagggtagcaaaaaatcaggaagagtcgtctgaccacatgcttcaggcaagcttttggaattgagtactggggggtaggggatggggaagagtaactatatatgtggaataagatcatataaattctcaagtgtttaataaaaattccagttatggatagcaaaatcttcatgttatgaataccatttaaaatagaaaaccatagtattgcatgttttagctttaacaataaaatgaaatgagacttttccttctatcatttaaacttgtaaagtgcaggaggttacatagcgtagtccttagatccagggctgggcttctagccaatgtgaccttgggaaaattgctatctgtgccttggtttctcatctttaaatagagataatagtaaggatctcctaagattacagagagaattacattagtgtatccacataaagtctcgctcctcaacttgaggttcaaggaccagtagcacttgcatcatttcggagcttgttagaaatgcagaatcccaggcctcacccctgacctagggaatccgaatctgcatcttagcaagatcccaggtgactcctctgcacctgtttgtgtttgaaaagcactgatgtggccggtcacagtggctcacacctgtaatcccagcactttgggggaggctgaggtgggaggattgcctgagtccaggagtttgagaccagcctgggcaatatagtgagactttatctctacaaaaaatttaaaagttagccaaccatggtggtgcatgcctgtagtcccagctactctggaggctgaggtaggaggatctcttgagtctgagagtcagaggttaacaatgaaacaagatcgtgccactgcactttggcctgggtgacagagcaagaccctgtctcaaaagaaaaagcactgatttaaagtacttggcatagtggttaacgtgtcataagcaatacaggccacaatgattttgttgtttgaaaaagccacatgagccaggcatggtggtgcagcctgtagtcccagctacttgggaggaagaggcgggaggatcgcttgaggccaggagttccaggccagcctgagcaacatagtaagacacacacacaaagccacatgatttcttcatgttgcatatgtgaaaaaaatctaaaataaaaagaacttttacagtccctagtcacaagtgtgtgaggtgaccaagatgtcactggtttcagtaacaacccctagctccttaagaatgcaccaacctctgagcaaaagacctaacgcctactcagagtatctgcctgggaaatggagagacctcaacttttaggagcctgcacctttagtttctctgcctccagcttggtctgctgatccaccctgggcttttctaggatttctgcatagacatctgttagagaagttgtgtcactccttttccaagtcttggaaaacaagtacacttaaaatttaactacctgaagactgagagcagataatactacagatccaaagcaaacagctacctatattcagactatggtcattttttaagactatgatagggctaagatttccttcttggacagataagtttctcacatgggtgggcatgaatatgacaatacttactgtacttactgtgtcaggtatataacacagccttatgtcatccaaaatcctatattagtcaaggacttcaaacttccctaaaggtaaaactcttgttggggctgtgtataagcccctatccccacaaccccagagaatttaagggacattattgagcccaagatggctttagataagttttttactttttacatgatcgaggttggcctaacttcttagagttgttgctcagaagaagaaagcaaacactgatcgcaactgtcccttctcttggattggtagggtttttttttttttaaattataacacaaggcttctggaccagtgctgtccaatatggcagctattagccacatgtggttattgagcctttagtcagagctagtccaaactgagatgtgctgtaagtataaagttgatgttgaaattcaacgaagtaatgccccccccaaaagtaaagtatctcaccaatagtgtatgttgattacatgttgaaatatcttggatattttggggcataagtatacgaaaattaatatttaaaatttggctgttagaaaatttaaagttatatatgtggcttacatttgtggctcacattatatttctattggacaacactgttctaagcaggggtcagcgaactttttgtaaagtgcttggtagtaagtattttaggctttttgggccacagagggtctctgtcgcatatttttggtttttattgtctttttataatcccttaaaaatgtgaaaactattcttagctcacaagttgtgtgaaaacagtctgtagttcggatttggcctgtggcccatagtttaccagaccctaatctcagtagaccggttaggtctgtgacctttaatattctgaagaataaacataaagctttaagattataaacatttgggaagtcagcatcttaatttcctctagaaaatactttgtgttattttcttacacattataaattgttcttcaaaattgagtgatgtagaacttttctttctctcttagtcatctgtctattttaaacattcttatgaagactggctggaaaacaacggactgagcatctcccctttccacataagatggcaaactgctgttttcaatcgtgccttttacagttggggacggcggaaagcaaggatgctttaccaatggtattcttcatcttcttttgtttggtttaggttaatcattaagtgatcacgacagacagcttgttaaattaactatttccattactttgcagttttctgagttttaaaatattgacaatattaaaactttctggttttatataaccttatgggattgtatcattgtggcttgcatacattaaaaatcaaggcatttatggcaatttatagttaggggctttacaatgatctctgggacacccaagatacaggcaggttctgtagatgagagaatgtgagggtcaggggtggcatggtctagatttctttttgttaaaaatttagccccaaatggattagagctaaatgtaaacaatcagatcatcagagttagcagaaaatgcaatagcagatcaaagcatacaaagtggaaagaaggatataataaagataagaacagaaatcagtgaaatagaaaatatacaatagagaaaatcagcaaagccaaaagttggttctttgaaaatattaattgggccgggcgcagtggttcacacctgtaatcccagcactttgggaggctgaggcaggtggattgcttgaggccaggagttcgagaccagcctggccaacatggtgaaaccctgtctctactaaaaatacaaaaattagccgggcatggtggcgcacgtggtcccagctactcgggaggctaaggcacaagaatccttgaacttgggaggcagaggttgcagagagccaagatcacaccactgcactgcagcctgtgtgacacagcaagaccctatctcaaataaataaataaataaataaataaataaataaataaataaatagaaaatattaattgataaacccctaccatgactgatgaagaaaaaagaaacgtaagtaattaaaaatgagaattgaggccaggcacagtggcccatgcctgtaatcccagcactttaggaggccgagatgggcggattgcttcagcccaggagttcgaaaccagcctgggtaacatggcgaaaccccatctctacaaaaaatataaaacttagccaggcgtggtggtatgggtctgtggtcccagctacttgggaggctgagttgggaggatcacctgagctctgggaggtgaaggctgcagtgagctgtgaccgtgccactgcactccaacttgggtgacacagtgggaccctgtctcaaaaacaaaaattggaattgaaaagaggacattactacagattctataggcattaaaaacatagtaagactattaagaaaattctatgcctataaatttgacagttttagtgaaataaacaagttccttgaaaagcacaacttaccaaagttagaaaacatggcagattatctccactatacaatggtagcttttaataattaaaacaatagaaaaaagaaattattattaaattataccatgttaatatttaagctcattttatcacaaagtaaagctgaaatacgatgcagacaatagaagaggtagatgaaaaaggatggatgtctataacgtcaaaagggctttcataacgatataaggacaagatcaaaacaatattatgtaaatgagcaagtgcatgagaggaaacaaacttttttattgggaatgatattcagattctttagttatcagagaattataaattataaaactgcttaaactagtgctcatgctgcagtcaaatatttgaagttcatgtaggaaaaagaagcagagttactgaaattttttagccattattttaaagctatgaaatgtggctgcttagtgaatttgctagtccatgaattgagagaaattgtaaattaacatgatttttttcccttttgacaggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggtaagtatcgtcttttcgctttaaataactatcgaaatagagatgcaagataccacttatgatctagtgtaactcctatccataatataaatatgaaaataaattaaaagtctcataattttcaaattacctgcttacacaaaaaaattaataagaatacagcaaggaattgttgaaatatttggtagtagttgtaatattaatggtaaaagagaacaaatgaaccatcattaagactgtcagcaattaaacagatacgtgactgtctttttaagatattaaatgattgttattttcaaagaataggcatgctgatttaagatctctataatgtataagtaaattgcattctaattatatgcaaagtgtttccctttccttttcatggccttcagagcctaaccaataatatccttttaattaaagatataagacctttctgaatggtcactgtgatttcttaatgtgaagaataatgtgctgagttgtactcctttaaaactcatgtgtagacctataccttatcattttatgtctccaaagtttggaagggggctttacattggctcacttttatttcacatttttacatttatagttcccatttccatgagtcatggatgttgtttttaatcatgttcttattaatggagtagactaaggattagtaacagattgggtttttttttcttgtctctttgtgtcctctactaggctgggtcactgggaagatttagaagtcatttgtagagaacaataatctctcctatggccatagctcttttttagagattaaaaagatttagcaggtgaggcctcagaagaaattatttctttcttcagcaaacattccctgccttacagatgagaaaatcaaggcacagacacgttaagtcacttgcctgtggtcacagctcataactagtagatccatcatcactgatcttacagcctatagacattatgctctattattattttattatcattattattattatttgagacggagttttgctcttgctgcccaggctggagtgcaatggcgcgatctcagctcaccacaacctccgcctcgcgggttcgagcgattctcctgcctcagcctcctgagtagctgggattacaggcatgcaccaccacgcctggctaattttgtacttttagtagagacggggtttctccatgttgatcaggctggtcttgaacttccgacctcagatgatccacccgccttggcctcccaaagggctgggattataggcatgagccactgcgctcggcctatgctctacttttaagagagacaaataattcttcaaggaactataagtaattttacttacagttttaaacctctaggtatatggtgggaggataggtgggactggaggcaagagaacaggatagtgcaggatataaggtgggagatacaggtagggtctaggttatgaagtttatgttttacctgtaggtagcaagtctgtacaaaatggaccaaagtcattagagtgaagatgtggagatcatttaagagcagtaatttattttagaagtgataaagatataaaattagtggcaaggagaatgaaggggatggattcaagtaagcttttggagtggaattctcagacattggtgattaattaaatgtgaggctggagggagaaggaaaagtttaggatgactctcaggttacacaattggttcttgttcaacaagaaagagggtaagagagaaagaagccagttggagaaaatatgatcactggcttatctgcctgctagaattagaatggcaaaacgttgtttagagaagaaattatttcttctctttgccactcagtttattcatagtactcacaaaaatgtcagctctattaggagatccgtgctttggaaccattaagaagtcagctgccctctggagcccaccatgcatattcatgtataagtttaagaatgttatgaatcctgactttgacatgagctcttgtagcttaagtaacatactttctgtttactctataattcctgacagccttgttcagtattaattctccaaaccatggcactctgtgttgttgaaagtattctgtattcagtattctggtacatctgataccctgtgtgaatcatggcagagacagatgggcaatcgtgtactgttgccagcaaataagacctaccatctgttggtattatcacacattcaaattcttactttatctcactcactagtacatgcagaaaataataaagagaaggaagaaatatcctattggaccaagcttactgatttatttgaaataaaggtaaggtaagcaggatattttgtgatatagagggtatgtatgacagtcttaagtatgtaaatttagagaggggtcagagaaaagtataatactggaaagatgtctgacaacttaggaatggagcaggtatataaaaagggacatagaagttcttgagaaaagttgctcaatagggtccaagtaaagagaatttcagataatgaacattataaacatatccatttcctttgactctttacctccacatctgggactctagcttaaggaaacactttcaaatatagaaaaaatagtattcattaagctctttagcctaacattatttattattatgaagaattaaaagcaaccaaaatatctaattgaggaatggttaaattattggattgtcattcaattagatattatgcacacattaaaaatgattataactagtttcggccgggctcagtggctcacgcctgtagtcccagcactttgggaggccgaggtgggtggatcacctgaggtcaggagttcgagaccagcctgggcaacatggtgaaaccccgtccctactaaaaatacaaaattagccgggtgtagtggcgtgtgcctgtagtcccagctatttgggaggctgaagcaggagaactgcctgaacctgggaggcggaggttgtagtgagccaagatcacaccattgcactccagcctgggcaacaagagtgaaatcccagcactttgggaggccagggtgggtggatcacgaggtcaggagatcgagaccatcctggctaacatggtgaaaccctgtctttactaaaaatacaaaataaataaataaataaaaattagccgggcgtggtggcggacgcatgtagtcccagctactgtggaggctgaagcaggagaatgagatgaacccgggaggcggagcttgcagtgagccgagatcgcgcgactgcactccagcctgggcgacacagcgagactcgtctcaaaaaaatatataaataaaataaaataaaacaacaacaacaacaaaaatgattataactagtttcttaactagagaaaggacacttggaattaatggaatttagaaaatgattcaagcagcattgtttgaatcttcagttactaaaggaagctttttagatgagatttctgtgtccataaaaataaattccagttgaattaaaattaaaacttgaaaccataaaaggccttgaaagaaaagacccatgttatcatttttatgagcacagaatgaggaagacatagagcgaatagtagaaaccatgaatattttttatgtaacagtaacacctttattttttattttttaaatactttattagagcagttttagattcacagcaaaattaagaaggtacggagatttccccccttacaatgatgaaccgacgtgaatatgtcattaccacccatagtttacattagggttcactcttggtgttgtaggaaaccatgaatactaatagatttgactacctaaattttatatatcaaaaactaaaaacaaagtaaaattaaaaggcaaacaaactgtggaatacatttatgtcatgtattacaaaggaccaatgctgatatttgaagtgatcttacggatcagtaagaaaaagttgaatactttaggagaaaacaagtcaggttatcagtaggcaactcgcagaaggaccaaaaaatggtcaaaagtacggggaaagttcagctttacaaatggtcaaagaaatgtaaatcacattgcagatttgaataaaacgagcttgcccaaggttatgaaagggtctgcttttagagtataatttgatgacatgtatcaaaatcttttaaattttgtgtaataatagcatttactaccctctctgtgaggcataacattaaacattggacaaagattagctcatttaatcctcaaaattacccttttgtgcaaatgtggttatttccattttaatgatgagaaaataggaatgttggaggaataatgccaactttcccaaggtcatttagctagttaagagatagagacaggaccggccgggcgcagtggctcacgcttgtaatcccagcactttgggaggcggaggaaggcggatcacgaggtcaggagattgagaccacggtgaaaccccgtctctactaaaaatacaaaaaaaaaaaaaaaaaattagccgggcgtggtggcgggcgcctgtagtcccagctactcggagaggctgaagcaggagaacggcgtgaacccaggaggcggagcttgcagtgagccgagatcgcgccattgcactccagcctgggcgacagagcgagactccgtctcaaaaaaaaaaaaaaaaaaaaaaagagacaggacctcaaacccataacatgtctcaagagcccaatcccttagcaagtatgctcatctaagaatttcttcctccaaaatatttaggtgtgtgtgtccaaatatctttatcacattataagagcagaaacttaattaaatgcccaacagtttattccatagaacacagtgtagctattaaaaatcatattgaaatagaaaatactcatgggaagacgtctgtgatactgttaagtgaaggggcaaatttcaaaaccagatttataataaaagtatagtttttaaaattatgtgtacaggaaaagactagaaggacatacatcagaatggttcacaatggttttatatgtgtatgtatgtttggggagcagaattttaggcttctgttttgctttgaattttccagttttcttgctttaaacatattttttataattaatataattataaaagaaagcagaaatttcctccaaaaggataccttttagtcccaactcctggactgtaagaaatagattctcagtatgtaaatggtattcctgagcctggtgtgtcccacttagcctaatttattgtctctctttaacagatgacataacttgggagtgattacttatcttacgagaatatatctttgctatctaaaaaaatttgctgtgcagctcttatcttcccttgtgtatgcaataatatatacctgcacattttaggagcacatgattgtaagacaactcctgcttcatatgtttgtaacatgtctgtaggttccaaatgccttaatttcgacattaaatttcaattttaatgtatttgtgtatctcttccacactatttttctgaccaacatagtagaccaactaatggaatagaagggtatggtgctcccacactgatcgggatccctattagaccagctttcattaccaactcacctataacttgaggatattaaaatgaaactcgctgattaataatatggagttcctatattaatcaacacaagtacttggaaccttgcaataacaattcagcggaaggtctaggaattttaacaaggattcccaaatcaggcatccagcccttgaggttgggtcagctgctgcctgcttcactgtcatcctgcattccttggcactttgctgggctccctcattctttcccaaggtgaagactccaggaagctaacatctcaactgtttaacctggtgtttctcattctctttagactggtggtgtgcttgttccagagaaactggctagttcgaaaaatgaaatagcgtttttgctttttattatgatagaaatggagaagtgaaccattgtcatattacttttagtttgcagaacattcagcttgaaggtttaatacagaatgaacatcatgtatcttagtgcccaagtgggactcccctgcacccccactgataattgctgccatattgtgtctatgaacaggttcctggtataaatttacccgtcaatcaactgacctatttcttcacggcagttctcattagtggtgttgtacatgaaattggacatgggatagcagctattaggtaatgatatttacctttttctttgtactacatgcaaaaaaaagcttttcatttaggaggatttattactaaaatctgctatatttgatacttcactatttttctttctgcggctattgcctagtgcatagccatcatttgttactttgaggaagcttctttttttatagagaagattaatatgttgatgaatatgctccattaaccatgggcatatctgtaatcagggtctttctatcctttgccttttccagtgtggttatcctcatgatgcctcaaagttttttaccaagtcctaaaagccaatctttctgttcatcgagtcagaatgataaccactgtactcaaaacccactcaccttagaacttgatttgacttatcagctgaaataatttcctgcttctgcttatgtcctctgctggctagagcaagaaaactgaaagcactgggtttaacaaatatcatagtctatctagaaacccaagtggaagataagaagacacctgggactagctttgagtatcactccctgttcttggtcttggcttcccaaatgtatcattgtaactatacctaagcatttagaagcctataacacatataaaatcatgatggggagagggccacgtcataactcccctgctacctccactgataattacggccataattagcaagcatgctaataggaatgtgttttatcctttcggtgtgtggaccagagaaaaggttaaaaacctctgttttggcagagaagatgtaatcacttcttattactttccagttgtttatgaacaagagtctatttattggcaataaatcctcatcttgacagagcatatactgttacacagatgtgcacaatagtggcttaaagtggtggctgctgggttttttttttcttttaaaatcgccttcagtgctttgcagcctttaggattttacctatagacacatcgttaataacagcttaacaatttacagtatgtttgtaaaaataacttgggtaatttttttttaagtcccaactgccaagaaaaaaaatgaactgtacggttgtcttatatatttagtattaagcaacagcacaatatatttaggtgatacttttttctaggggggctgtttggttttatgagacttaaatattaatttttggaaaatgaactgataaaaaatggttctctttttttttttaatatggagatcaaaacctgctgaaaaaactggttctcttaaggacaatctgagcattatgcatgtttaaacatacttatttaacgttagcttgataggaatacacctagataaatctccaccattatttataattgctaagacaaatacaagttattaggtaatttacttgaattatatcgtctcctatgttcttctctgaaaatagttcagagtaaaccataaaaatgtttttcatttagtttctcataaaagccatttctgtatatatgtgactaacttcaattatttgctcaacatattggtttctaaaaattttgaagttatgtctatttcagtatgccctattttgcaaaattcaatttcacagataaccaaatctgtacattattataaaattaagattatatatagtatagatataatttttttggctgttcagagagactttctgttttttaagcaagaattcaaattacagtgaaaagttttaagattatgtacactattaatttgataaatataatagtattagtaaactcctttttcttatgtgatttcttagggaacaagttcgatttaatggctttgggatttttctcttcattatttatcctggagcatttgttgatctgttcaccactcatttgcaacttatatcgccagtccagcagctaaggatattttgtgcaggtaacagacttaattttgttttaatattcatctgtggttttggttttgattttctatggttagtgctttttggaaaatatatcacaaatgacaatatcttatcttttggttaataacttcagtttataagaccccttcaaaagtagaggagtaaaataatttacattccagttgcttccttaaaaccaactaaaaacaacataattttaaaaaatttaaaaacagaggaaaactttgttttgtccacaacatgaaatcacaaactatgaagaatgtcaactcagctgaaatagaatgaaatttgcatcaaatcaagggagaatatgaagaattgactaagagataaatcaaaagtatccaggaatggaaaaaaagggttatgaaaggatgagtagtgaactctagcactgtcagagttcaatcagagaaacagaatcccttggagatggaaccacagttccagctgagtgaaactgacatacgacaaatccatcacaaccctgcatcacttttaatggaataactgaggctaagcaagtgtggagttagaattctcaaactaacaacgacaacaacaacaaaaaaaacctgaaggtgggaaaaacaaaaacgggaaatataaatactaatttcctcaacttcatagtggagaggacatctgcctgaacctgataaatcaagaaatagaggcttgagtatatcacttaagattataaatgtaaatactacaagatctaaaaacacacataaacttttcaagttatcacagtgaaagcatgaaacacagaccaaagaaaacagaccctatatcaaaagataaaccatggtaatgaatttaagaccaaaacacatttattttgtcaataaacataaatgaaataagctcacctactgaaagaaagatgcccttagtttgtatttaaaacatgtcccaaatatgtgatgtacaaaataaatctgtgtaaataattactcaaaaataatgaaagtaaaatgatgagcagaacataacatgcaaatgggaacagaaaataagaccaaaagcattatattagacattgggggccatttaacaataataaggaatataagccacaatgaaaatataacagttgtgaatcttactgtatcaagtaacaaaccatcaaagcaaaacaaaaatgggaaaagtataagaagaaacaggtaataaaaagactcacgctttaatacatggcagataagtataaaaaagttaggctaaggtaaaaataggtatgtcaaactctataccgtgaacacagaagacaatattttttcaagtgcccatgggacttaaagtcacagtaaattcccaagagaagactagcaaactaagtaaaaactacctgaaatttagaaatttatcttaatcacaccttggatcaatttaattcaaacctgtgatttcagtagatctaaaaattatgatgatgaaatcattttactgagataatgtttaaagttttgctaaaagaaaaatgcactgccttaggcagtcatgcaaatacaaatggaaatagattagttgagtattaaacttaagtgagaaaagaactgtaaaataattaagaaatgatgacgtaattagtaaggatataggcagaaaataataaattagaaaaaacaaaactagatctgctaaatccaagagctcttaaaaaaaaatcaaaggtcgaacaatgagaaaaagcatctaaagacaattagcaatcagattggggaatgacaattgataacagagaaaataaaaacaattataagtgttgtttgctcatctccacaaaaaaaatttcaaaaccctgtataaatataagaaaataaaaatagctgaaattaacccaagaggcaatcaaaaaaatctaaataggcaaataattacaatgggagaaattaagaaagttgataaagaacgccctttttcttttgagatggagtctcgctgtgttgcccaggctgtagtgcagcggcatgatctaggctcactgcaacctctgcctcccaggttgaagcgattctcctgcctcagcctcccgagtagctaggattacaggcacgagccaccacgcccagctaatttttgtatttttagtagagaaggggttttgccatgttggctaggctggtctcaaactcctgacctcaagtgaccctcctgcctcggcctcccaaagtgctgggattacaggtgtgggattgctgtgcccggcccagctactctggaggctgaagcaggagaatcactcgaacccaggaggcggaggttgcagtgagccgagatcgcgcgccactgcactccagcctgggcgacggagcgagactccgtctcaaaaaaaaaaaaaaatccttagtaaaagtaggaatagctgcatacatcataatagcacaacactttgcattcctattaaaggacaagacaaattctactatcaactattactgatattaaatgtcgtattagtgcaattaaataagagaaaaaagcataaaaggagtaggcttttttggcagatactgttatatgggatggacaggaggggaagacatgaaaatcaactaaaatgaaatacataaaaaatcagtaaagagcctgcttacgaaagtggaaaaacaacagctgggcggggtcgcagggtggcaaacgtacgcgggcacgtgcacgtgcttttggggccgacagacgcgccagttgcctaggcgcatgcgtctggctatcccagaagcacctgcgccttccggctcgtgctttcctcagtctcgcgcctttctctgcagctcgcgcctttctctgcagctcgcgcctttctctgcagctcgcgcctttctctgcagctcgcgcctttctctgcagctcgccccttcctctgcagctcgccccttcctctgcagctcccacctcactcccctcagcgttctttttcccacggtcttcccgttgccgctaacctaactaactctcagccatggcctccaacgaagatttctccatcacacaagacctggagatcccggcagatattgtggagctccacgacatcaatgtggagccccttcctatggaggacattccgacggaaagcgtccagtacgaggatgtggatggcaattggatctacggtggccacaaccatccgccattgatggtgttgcagccgctcttcacgaacacgggctatggcgaccacgaccaggaaatgcttatgttgcagacacaagaggaagtggtgggctattgcgactcagacaaccagctaggcaacgacttggaggaccagttggccctcccggatagcattgaagacgagcacttccagatgaccctggcctctctgtcggcctcggcggcatcaacatcaacatcaacccagagccgcagcaaaaagcccagcaaaaagcccagcggcaagagtgccaccagcactgaggccaacccggcaggcagcagctccagcctgggcacgaggaagtgggagcagaagcaaatgcaggtcaaaacgctggagggtgagttttccgtgactatgtggtcccctaacgataacaatgaccaaggggcagtgggtgaaggccaggctgaaaacccacctgattattccgagtacttgaaagggaagaaacttcctcctggggggttaccaggcattgatctctcagatcctaaacagctggcagaatttactaaagtgaagcccaaaaggtccaaaggagaacctcccaaaacagtcccttgctcttatagcggctgcgaaaagatgttccgggattacgccgccatgagaaaacatctccacatccacgggcccagagtccacgtatgtgcagaatgtggcaaagcttttcttgagagctcaaagctgagacgacaccagctggtccacaccggcgagaagccctttcagtgcacattcgaaggctgcgggaaacgcttttcccttgatttcaatttgcgcacacacttgcgcatccacaccggcgataagcccttcgtgtgccccttcgatgtttgcaacaggaagttcgctcagtcaaccaacctgaaaacccacatattaacgcatgtgaagaccaaaaacaacccgtgaaaaggagaagacccctctcagacttgggaattatcttccaggactgcggtagggaataaatatgcctctcaaagctttgtatgttgtttctaagagttttaaaaaaaaatgaatcctgcacatttaaggttcgtgttttgttagagtagtaaaaatagaatttaaacgtttttaaaaaggtaaaccttgacataagataatagtgctaagatgccatagcttgttctgtaactatttttgtaaagtttggtcccaacaggagaaaaattcgtagacttcacatcaagagacggttcttacaaactgtttaaaatgggacttttcacattcttagaaataggaagttcatttattgtttacaatgtttttaaaaaacttgttaaaaaattcaaagtgttcatgtttatacttttaggaatatgcttaataagtctatgtatggtttttctggaggttgataactttgggaaagatttactttaaaagagtgaacaattatatgcatacgtgaagtattttcctgcttaaaaaagttatataggtgttatttgttttaatcttggttgtagtcttggatgttaacacatcttgcattttagctgtattaggtcatgtagtattgatattaggtgatttaatagtactagtttaaacctattttagtcattttattttccccaaaatactaccagatgctgttgtttagtgtaatttctttgcctgttcagttaaagtagtgcttgcttgtagaatatattgtgtatatgttgactttaacacttaagaagtacatcctgtgtaatagaaaaagcaaaataaaacacctcttctaaagaaggaaaaaagtagtttgcctatatcagtacagaagttagaactaaagaaaagggggagggtgctactggcatctggtgagtggagggagatcaggaatgccactaaacatcctacaatgcacagacagccccacgaaacacataattatttggctaaaatgccaatagtgtcaggtgcaggggctcaggcctgtaatgtcaacactttgggaggccgaggtgggtggatcgtttgagctcaggaattgaacatcagcctgggcaacatggcataactcggtctctaccaaaaataaaaaaattagctgagtgtggggcgcacacctgtggtcctagctactcaggaggctgagatgggaggatcactggagctggggaagtcgaggctgcggtgagccgtgatcgagccactgcactccagcctaggtgacagagtaagaccttgtgtcaaaaaaaaaaaaaaaaaagagaaaaaggggcagaggggctgggcgcagggctcctgcttgtaatcccagcactgtgagaggctgaggtgggtggatcacttaaggtcaggagttcaagaccagcctgtccaacatggtgaaaccatcccccggctacttaaaaatacaaaaattagccatagacttcgtagacttcacatcaagagacagttcttacaaactgtgtttaaaatgggacttttcacattcttagaaataggaagttcatttattgtttacaattttttttttaaattgtaaaaaaattcaaaatgttcatgtttatacttttaggaatatgcttaataagtctatgtatggtttttctggaggttgataactttgggaaagatttactttaaaagagtgaacaattatatgcatacgtgaagtattttcctgcttaaaaaagttatataggtgttatttgttttaatcttggttgtattattagatgttaacacatcttgcattttagctgtattaggtcatgtagtattgatattaggtgatttaatagtactagtttaaacctattttagtcattttattttccccaaaatactaccagatgctgttgtttagtgtaatttctttgcctgttcagttaaagtagtgcttgcttgtagaatatattgtgtatatgttgactttaacacttaagaagtacatcctgtgtaatagaaaaagcaaaataaaacacctcttctaaagaaagaaaaaagtagtttgcctatgtcaatacagaagctagaactaaagaaaaaggggagggtgctactggcatctggtgggtggagggagatcagaaatgccactaaacatcctacaatgcgcagacagccccacgaagcacataattatttggccaaaatgccaatagtgccaggtgcaggggctcatgcctgtaatgtcaacactttggaaggccaaggtgggtggatcgtttgagctcaggagttggacatcagcctgggcaacatggcataactcggtctctaccaaaaataaaaaaattagctgagtgtggggcgcacacctgtggtcctagctactcaggaggctgagatgggaggatcactggagctggggaagtcgaggctgcggtgagccgtgatcgagccactgcactccagcctaggtgacagagtaagaccttgtgtcaaaaaaaaaaaaaaaaagagaaaaaggggcagaggggctgggcgcagggctcctgcctgtaatcccagcactgtgagaggctgaggtgggtggatcacttaaggtcaggagttcaagaccagcctgtccaacatggtgaaaccatcccccggctacttaaaaatacaaaaattagctggggttgctggcatagcacctgtaattccagctacttgggaggctgaggcaggagaatcgcttgaacccaggaggtggaggttgcagtgagctgagagagtgccactgcactccagccggggtaacagagtgagactccgtctcaaaaaaaataaagtaaatgccaatagtgtccctgttaagaaaccctgctgtagaaaaagtaaaagtttataagaaagattccagaggtttgcagtacttataatccaatcattaatgggcaagaggttgttcagatgaaagaaatgtttgtgctccaccaccctcattgccgcttaaccagcatgggtaaatccagaatcagaggggtgatctggtactagctacatgcctgacgagataagagactacacaaatagtcaaggaatcagtgctgctgagtgtcccggcttttactcatttgttcatgtcttgtttctgtgactagcaactgagctggggttggggggaattcatagtagtatcctaaattagtttccccagagtaaattactgtgcatcaaaggattaggttttttaaattttgttttaattttgttaaggaagctatgaaagcagtacaagaaaacacaagtgaatatcttttataatcttgaggtggaaaaggcttagtacaaggaactatttgatcacacaaaaatttaaagtatctgtacaggcaaaacaacaaaccacatcaaacaacaaactggaaagataaaattataatacctgttacaaaggaccaaattcctccctatatagattataaataatagcatatacaaattagtaaattaataagacaactcaatcaaaaaatggcaatggatagaaataagtagctcttaagaaaatgggctttaatttttcacccagaagactggcaaagagtaaaattatgatagcatccagtgtcattcagagagtggaaaaatgtcaattatgagagtataaattaattcaataatgcaaactcattggaggtcagctttaatgttcatattttttgacccaacatttccatttctaggtaatttttcatacccttgcagatgcatacttaactggacgcctaacattataagcaaagctgtgtattgcagtattatatgaaaaggttaaaacaccctaagtgattaatagtaggataccttataaataagttgatatgttaataaaaatggattactctgtagcagatataatgagattgatatttatgaacagatatggaaaaatgtcaaaaatatataaatttaaaagcaaatagggtgtgatggctcacacctgtaatcccaaattttaggaggctgaggtgggaggatcacttcaggagttcaaggctgccatgagctgtgatcacagcactgcactccaacctgggcaatagagcgagactgtctctttaaaaaaaacaaacaaaaaaaaacacgaaaaagcaaaatatagtataataatttgataccattggtatttttaagtgatgtatctgtatataatagaaaagatcatttacctgataagtcctagaccatactttgtctggctatttctggaatttaataatttacaacactttaaaaattttaaaaggaacattttacaatgtgaattcattacttggaacatgtgttagctaggtatttggctgctctaataactaaaaataagtggcataaactttcaaaacattccaaatataagtagttcagtgttgatcggataactctgtaatttgggtacacaggttctgtcttgttagctctgctattcccaacatgcagcttctgtgtcgtggacctaaatccagctccatcatagctacattacagcccacagtacagggttgtctccatcacatcctggtgctagtagtgcccataccccgccccataaggaaaactgcaataggaaaagggaagactaggtatgggggaaggggttatctagtggcgtgttaagtgaatgtttaacatctggctctgcagggctaaggtagggagctctgatggtagcatttgctggtttctgtggtgtaaatacttgcaccgtggtcagtttcaagctgcaaacctgcacttcctgaaggaggaattaggaagaaatgcacacaattaactctggcaagctggtaggagcaggcttcagagaaccactgggttcatataaccatatctgccataggataggatataagatgctaaggggaaaaaaagagtttaaaaaatataggcctggtgcggtggctcacgtgagcctgtaatcccagcactttgggaggccgaggcgggcggatcacgaggtcaggagatggagaccatcctggctaacacggtgaaaccacccgtctctactaaaaacaaaaaaaattagccgggcgtggtggggggcgcctgtagtcccagctactctggaggctgaggcgggagaatggcgtgaacccgggaggcggagcttgcagtgagccgagattgcgccactgcactccagcctgggcgacagaacgagactccgtctcaaaaaacaaaaaacatatatatataaaaaacatatatatatatacacatatatataaacatatataaatatatatacacatatatataaacatatataaatatataaacatatatatataaacatatatatatatatatatatatatatatatatataaaaccgactgggcgcggtggctcacgcctgtaatcccagcactttgggaggcggaggtgggaggatggcttgagctcaggagttcaagaccagcctgagcaaaatggtgaaacccctgtctctagaaaaaaaaacacacacactaaaaaactagccgagcatgctggcacgcgcctgtagtcccagctacttaggacactgagtcaggagtgttgcttgagcccaggaggcggaggtttcagtgagccgagatcacgccgttgcactccagcctgggcgacagtgagactgtctcaaaaaaaaaaaaaaaaaattaaatttaaaaaaaaattaaaaactataaaactgtcttgaaaaagttattagaaaacttgctgctttgtactcttgagtaaattattaaaattattacacatgtatactcatatacatgctgatgtgggcagagaaaatctggagtaatggaaaatgataacagtatgcttactgtgagtcatggggctggtggttgagaaatggtatttgggaaagatgactttttattacttctatattgtttggaatttttatagtcagtgtgtattttttagtaattttttaaaagccaattgaacatttttaaattaatttcatattagggttaaaatgtactgagacttctttttccttaaaattgacacctaatgtccaaaactaagactaaagaaggttatatatatccccaccaataattgggtccacgcacctctttcagagcttattaaatggtatagaactaactagtcccgctatcccaaacatcacctagcccattaacttctcattcccagttgtgagttgtcagcctagtagacagctgaacagctttgccctgccgtctttcccaggcaagggggcaaggttaggggtggggaggagatgcttatcttgccctgaattcaagacaggacaaattcaaagatctggaattgtctctaaaaagaagagtttagtatccctgctaaatgtttgctgagctgtgagctcaccgtggtgtagccatcaaagtggaagacaacgtgggaaacctgtgtgttcctcaaagtttagggatgtacataaattatgtatttagagggagagagaaatatgtgtgtaccctctgcctactttattggttttaaatttaggaatataatttcattgcttctaaaatgtcttcccacttccatgtaaaaagtccagggtgtcatttaaatctagttttttgttttgttttgttttgttttttgtttgtttgtttgagacggagttttgctcttgttgcccaggctggagtgcaatggcacgatcttggctcactgcaacctccgcctcctgagttcaagtggttctcctgcctcagcctccgaagtagctgggattacaggcacctgccaccacacccagctaattttttatgtttttttagagatggggtttcaccacgttggccaggctggtctcgaactcctgaccacaggtgatccacccgcctcagcctcccaataaatctagttttataatgctacttttaaagagttgcatatataggccaggtgtggtgactcacgcctttaatcccaacactttgggaggctgaggtgggcaggttacttgagctcagaagtttgagaccagcctgggcaacatggcaagattccgtctctactaaaaatacaaaaaattagctgagcatggtggtgcatgcctgtggtcccagctactcaggaggctgaggtgggaggatggcttgagcctggggggcagaggttgcagtgagcagagattgtaccactgcactccagctggatgacagagtgagaactctgtttcaaaagcaaaataagttgtatatgtaataggtttttttctttttttctttctttctttcttttttttttttttttctgagacaggatatcaccctgtcacccaggctgaagggcagtggtacaatcaccgctcactgcagcctcgacctcctgggttcaagtgatcatcccacttctcagtctcccaagtcgctggcaccacaggtgtgcaccaccacacccagctaatttttgtattttttgtagagaggcgggtcttgccatgttgcccaggctggtctcaaactcctgggttcaagagatacaaccacctcggcctcccaaagtgctgggattacaggcatgagctagagctaccacacggggctatttctttaaaaaaaaaaaaatgaaatatatactgattttgaaaagaaaaagccactaaacatctgtctgaaatttggtggggaaaaaagagagatgagatgagatacttcctgagcacactgtaaatgaagatgtttaaattttgaattatggtgtatagaatttttagaagagggattaaacaatacctgctatctggttccaagtgaagagtagattgctttaaaaaaattctctatgctttgttgctaaaaattcctttataaatagtggaagtaaaatttgaccattctgtttctatacttaaatgtttttaaatccttcttaaatattgaaaaccctgttcttatttgtataagccagttgtaagtttatttgagggcaaagtaaaaaacattggtgataaaagtgatgttgtgattatagtaagctggaatttaaacttagaacacagtgtaagccttgccaaattgatagtttacattctttcagctataactactgtgagttattcaaggaatattgagttgttattttacctattcagtcatctggtgacctgtaaatcatttctgtgtgtttagagaattaaggtagttgtggtttttttttattattatttgcaaaccacactaagcataagtagggcttgattggggtagcccttagcccccgcttaataataatcaccagcttcaagtctatgggtatcttgctgccttgatgacaactatagattttcttctcccttgacccatgatttttgtttgtttgtttgttttgtttttttgtttctttgagacagagtatctttctgtcacccaggctggtctcaaactcctggtctcaagtgatctgcccacctcagcctcccaaaatgctgggattacaggcatgagccaccgtgcccggccccatgatatttttaaaccctgagtctcccatattctgatttttctactgttgccccagtctcattgcttagtatataaaccagaataaaattgatcctcaattccatctaagtcctactgtttcttggctgttgttttattaaaatcatgaagaaagcaaaaaaggcattccatcacaactattgaaaagtgttctagaagttacagtcattgctataagaccaaacaggaaggaaaagatgaggtatgaatgttggaggagataaatgattattattagcaaataatggaaaatccaagagaataaagactaagacatcctaaatggaaagttcagtttggtgattaattacaaagtaaatatacaaaaataaatgtagtattcctgtgtatctgaaagaaacagatcatgtaataggaagaaaagatctcattcagaaagtaatgtgacatataaaaaataaaaaactaacattttaaaagaagtacacagggcctatatagagaaactacaaatctgtactgagagatgtagaagatttcagtaaacagatgtcgtgttcctatgtcagaaatgtaaaattatggatttacccctagttattgcagtcattgcagtgacattagaaatcctaatgtgggccaggcgtagtggctcacacctgtaatcctagcgctttgggaggccgaggtgggcggatcacttgaggtcaggagttcaaaaccagtctggccaacatggtgaaaccctgtctctactaaaactacaaaaaaattagccgggcgtggtggtgggcgcctgtaatcccagctactcgggaggctgaggcaggtgaatcacttgaacccaggaggcagaggttgcagttagctgagatctcgccactgggcaacagagcgtgactctgtctcaaaaaaaaaaaaaaagaaaaaaagaaaaaaaatcctaatttgaataatatttggtggttgtcaaaatgattctcaaatttatcagaaaggataaggggagaataaccaaaataaacaaattgaaagtatttatttactaaatactgaaatattactaccagcaacagctttattgtcactggaatagtggaaaagaatggaaattccagaagcaagccaaagaatagatgaaaatgtattgtaaattaaaagttgcatttaatttagtagggaaagaatgcactgctcagtaattattagctaaacatttgaataaaattagttatatgtatcagtcacaccatacacaaaaataaattccaaatggtaaaagatttaaatgtaaaaatcacacacatacacaaaaataaattccaaatggtaagagatttaaatgtaaaaataaaactatttaaaccatccttctccacaaaaagagtgattacttacataatgttaggggcgagaaagtcttcctttgcacagctgcaaaggttgaatatataatggaaaagattaatgaatttgagtacctaaattttagggtttaaaaaaaaataataaagacggttttctctttttttttttttttttgagacggagtcctgctctgtgctatgtcacccaggctggagcgcagtggcacgatctcagctcactgtagtctccgcttcccgggttcaagcaattctccagcctcagcctcacaagcaactgggactacagacgcgcgccaccatgcctggctaatttttttgtatttttagtagagacagggtttcaccatgttggccaagctggtgttgatctcctgacctcgtgatccgcccgccctggcctcccaaagtgctgggattacaggcgtgagccaccgtgcctggccgacagttttcttatggtttgttgctttatagtctgtgacgtgatgtaaaatatatgctcggtttgttccaccaatattgttctgcataatagtttagttcttaaaacaacctcctttttccaagtaccatttgagtttctgtacccctgtttagcaagagttttttttatttgaatgtatatgaggtttctttcaaagatcacaaatatgtttaaattagtgatatatacattttctgaaaagagagtataattagtggaagatattagttctatcagtatcaaatcatgttagcatgtggtcttcctagtgtggtattaacatgcccattttagatttcaatatctaaaatgaaagtaactaataattgaacatctgtctgctctactaataagtagatatttttgcctcattgcttcttctgatcactttattaatttatcagaatgcccaagtgttgtgaggtccagctacttatatcattcctgcccccggttgagcttattgctttttttcctctctttccaggtatctggcataattttgtccttgcactcttgggtattttagctcttgttctcctcccagtaattctcttgccattttactacactggagttggggtgctcatcactgaagttgctgaggtaaataatggattactcagggcattctttcatcagatgttgtgatgtaatacctagcatctattcagaaacttttattcaagatctcttcatatacaaaatgcttagtttcttctgaagaaattactgtagtcctctcaaatctaacaaataatgttgggaaacacattggtttttttaaagtttcatgaaaattgtttttgtcctgatgctgtacttaggaagatagtatcaagattttctacctgtagtttattggtaaaatgcatcatttaccttttctgtttatttttatatctctgcttttgagtcaaatgtctttacgcctcctaagtagtaagaaagatgaaacctaggctgtccagccgtaacatttcataggagtttaagttaatgtcttcaactctgtatttcactcccttagacaataactgctatgatggcatcaaatcttgtattcagacattagaaagaggaaaattacctttgtgagcaattggcttacatatacattgtactgatggtattgcctgcatattggggatatgaaaggatgtgtcttattgttttatgcgttaaggatataggaaaggcaagacagtctgatgatactttcaccaaaaaatttttaattggcagtttgggaaaaaattttatcattttagtcttaacagtcagcaagtcggctttttttcaattgtgaaaaattcaaaatcttggagaatttgggaaaagcaactataattgttgggttttattttaattttctaggactatgtcttgaattcaaagctggattattttctgcattcaaactattcacttaattaactcagtgtctttattatttgctcagattaattatagcttgtcttcatgcattatctgatttggttttaccctcttcccaaggactctcctgccattggacccagaggcctttttgtgggagaccttgtcacccatctacaggattgtcctgttactaatgtgcaagattggaatgaatgtttagataccatcgcctatgagccccaaattggttactgtataagtgcatcaactttacagcagttaagtttcccagttagaggtgtgtatatttcctcaatataatataatgcttcaagcaccagtacctgccattcactaatccttaaaccatgtctatacatttattctgttctaatctgtttaaagcaaatcagtaaagtaaatagattccaaccaatagacatttttcttggtaagttggatgctaatatgtgtttcctttattatatattgttgaacttctaactattttcattatatcatatttaacttttaggactctaatattttctgctttcaaaacacttgtattaaatcatagccgggcgcagtggctcacgcctgtaatcccagcactttgggaggctgaggcgggcggatcacttgaggtcaggagttcatgaccaacctggccaacatagtgaaaccccatctctactaaaaatacaaaaattagcagggcatggtgacgggtgcctgtgatttcagctgctcgggagtctgaggcaggagaatcgcttgaacccgggaggtggaggttgcaatgagccgagatcgggacatggaaagagactctgtctcaaaaaaaaaaaaaaaaatcagcattcaaggtcaatcataaccaattaactaattccaataatcaaataccccaatataatattatctttatgcatgtctgtagatatattatagtactttaaacttttataattgaaaaagggaatataagtaataagaaccggttctactttgcataagcttatgtcagaacagataaacaacgatagttaacaactaaatatataaaaatcaaagcataaacattctgtattaatatattgttagcccaacacagacatgcaataaggaaagattacaagaaataagaaggaacttggcaaacaaaaaaccccatctgggatttagaaaaaattcccttacttcttaaaaattcccttaatacttaaacagttctagtggaatcagtgttggcatgtctgattctatctggggtagagttattttatgtattttatgtggcagccatcctaaagaagttgtcttggcttccaaaaataccatgtgaagtcagatatgttgctctgtgcagcagatgacagagctgaggcaagtttcttctcggatcctgccaaacttatttagagttatttcagctctgaaaaatcagcttcccaattctttatacaaaatcagcttcccaattctttatacaaaattggaggtgttagaaaatagaaattatgctcacagactatatctttaagtaaaaaaatatcctgatacttgtccacatctattggtgtagggaaatatgattaataatcaagaatagttttagtaaagtactgtgtgcaacacaggcaaagtagtaagaactgatttttttaaaaaaactttttaaaatttactcatttgtaagaatttttttattatcaaaaatgtttagacacgatggagaatatatttcctcaatataatataatgcttcaagcaccagtacctgccattcactaatccttagaccatgtctatagatttattctgttctaatctgtttaaagtaaatcagtaaagtaaatagattcaaaccaatagacatttttcttggtaagttggatgctaatatgtgtgtttcctttattatatattgttgaacttctaactattttcataatatcatatttaacttttaggactctaatattttctagtataaacgagcccacatgtatctttctgccagcttcggcagttattaacattttgccaattttttcatctaagcagtccacttttaggggaagtattttaaagtacatcccaggcatcctatcatttcatccataacctttcagcctgcctttaacggatgatgactcattaaacacgaccacaatactgttataattcctaacaaaataacactaatttctgatatctggttggtattcagttgtttctaattcttttcattatagttgatttaaattagttaggatgtcttctaagactttttaaatttgtaacaattttccttgacctgtttttgaaatgttatttttttgttgaagaaactgaggcatttgttttgttgaatttcctaaattctgggtttttctggttatatcttatcctcatgatgtcattaacttgttcagatgtcttccaattttctataaactgctaattaggtccatggcgttgattagattcagaatcctttttttttgtttgggttttttttttggcaaaaacacttcataaacagcgcttggtacttcctgtggcatcatattgcatccagtatctattgttctctgttttaatggtgttaagattgttcagtggagcaatctgattctttaaggttgaaatatttataaattttccccattctcaggagcctcttaccatcttccaaaacttttaagatgacagaagattaatatgtaatccacaatgtgttcttctttaaagaaatgatccattattttccacttcttaagtcctttatccttttcttttggtttctctaaatttgatgtaatgtgtattgaattacaaaaaccaaagtgacacactagttaaataaagttctcttcagtaggattgttttacttaggatatctgcattttcagatgtttagggttttatccttttcctgacagacagactgtaaataaaaattttccctgaaacactcagaaactctcttcttattaactgtttgagtatttcactgttgtggatcatgtgctacattttggaggtatttgtttaaatacctaaagcagatattactctttttatactacaatcaatccagaagtaattcttttttttttttttcaagccctgggctgtcccagcccaagagtaattcttcaatatctattttgtctcagtatacatgtttattttacatgattactatatctgataaatctgtgcctctatttaagcttttgaaaatggagtatgtatacttagccagtttaaaggagtattaatgtctgtaaatatcacttaaaatacatactatggctggtccaaatgcagttgtgcttacaattaattgaacacaaccagttacagaattctttgttccttctctattcccactacatcacttgactagccttaaaaaaaaaatacatactagattaattttgatggcaggcttagcccctgggtctgtggacatttaagaaagctatggattgatggtattttatatgtttctaggtaacttcgttatccttcattgtaagtaggagtgaaagatatggtcagatatactattacagagtgtccaatgatccaaaagttattcatgttcaatttagagtagaattcagtacacataactaaattctaggaatttataccatttcagagcaataaagccacctaggaaagatcacaccctggaagtgcttgtaaaccatctccaccaattatctctagcctcttatttcatatcctgtctctctcagatgcagtattagatttaaactctttgaaggttaaacggccttttggggaaactccaagaagaacactgagtgagggcttagagccctttgtacctggaatagatctctggtcttatctgggtcagaacagaaaaacatacactcttcccccattcatattgaagcctctgcttttagggttgctggctgtccatacaccactcagtgatttaaatagaactgaaagttttagacaataactagtatggctcttttgggggactattttcctagcaagtactttgtattttcactctttattttgagggaggcactccttatttcatatatgcataaagctaaattcctttttgatgaaagcattgtcttgagtaagaaaggctgtccttagcaagtccagcatttgaactacattttaaggagcacgagacagaatgctaaggcaactctgcttaaaatgaagctgtgagcccagactcaggcatccaccgtgaacagtttacattcctgttcaaaggaggtgagggtttatgcccttacctgcctggcaacagaaatattaaactgtcttacgtatctttaactggaatgagagaagacccttcttgacccagtttaagataataaaaggaaaactctgggaatcttttcaacaaactttgagaactcagattttttttatgcccaaattgctctaatatttgaaaagcaaaaagacctttttttgttattatgagcatcaagttatggtccaaggtttctttgctatcctaaattgaagagtaagagtgtgtatataagtatatatgtgtgtgtctgtgtgtgtgtgtgtgtgtgtgtgtatatatatatatatatacttttttttttttttttttgagatggagtctcactctgtcgcccaggctagagtgcagtggcgcgatctcagctcacagcaacctctgcctccctggttcaagcaattctcatgcctcagcctcccgagtagctgggattacaggtgtgtgccaccaagcccggctaatttttttgtatttttttagtagagacagggtttcaccatgttggccaggctgttctcaaactcctgacctcaggtgatccccccgcctcggcctcccaaagtgctgggattacaggggtgagccaccacacccagcctcgtgtgtgtgtgtgtgtttaattttactacttgttactaggcaatgatggcataaagtcagcaacagaactgagaataaataggcttgcttccctgtgttggagccctagctatgtgttatatatttaataagctagggtaagaaaattgttcagttcatattagagatacagaaagtggtaagcactgtgaactagagactgaaaaaatctcttctctccagctttattccacagtcacctctggtctagaccattctttgtagactggactatttctgtgactatcttcgggctcatcttagggtacattcaaaatatacaagttctccctgtagtaacattatgaaacttttctggccttaaatttttctgattgtctcccacactggggatatttaaaggacaattctaatcttctagagttaaattgaacccataaattcccctggggacatcctattgcaatcttgaatattagttccaaagtagaattgtattggcctctcgtaattaataaaaatacatgaatgtaaaaattatctgtgttgcaccccctcatcttatagattaagaatcaagtcacagaaattggttgagtaacttgttctttatgtgacccagtagaaaagattctaaaattaactgtttaagcctataactttttaaaatagtgatagagaaatatcaagtttacttctcacatgcaaacaaaatatttcactctttattggaaaattcagtatgttaggaggtacttaatcttgtcagggaggccacagccatggatttctgttttgcttggaataaatgccagaggaagaaaaaaccagagatcacaaattggtggcagcctccaggccaaatccagccttagcagatgtatttgctttggcttgcccagtgtttttaaatttttaattggctgccaatgtttaaacttcaacaggcttcacatgaaggttcagatttctggtttctgttgggacaaaatggaagatctgtcgattctgggccccaaattgagtggcctggctgctaaccccctagaacaggccatgtattttctagttcctcacagttcccaccactttgttttttctgcatatgatccacttcatttatttggtaccagcttggcccatttaagcatttatattagcaaacatgccgtatcattagcgataataaattcctgacttccaattctgtattgtacccagtcctcttaagaaaagttagtaattaagcatcagctgtaaacattttaagatcattactgatgcaaaggcaaatcgggtataacatcatttatgtattcagtgtatattgagtaatccaccttatataagacactgagaaacctttccctcagggagctcaaagttgagtcagaaaaacagaccatacccacattattacagtacaagtttaaatttaagtaatgacaggcaatactgggaaatgataacagtcttgactgagaagatgaaggcaggtttcacagcatcagcccttgaactggccgtcaacagtgagtttacttttaggacgtcaagatggacatggacctcagcaccatagaatagaaggtggtcaaggaactgccagtaattcagtttaggaagagaatcatatgagataaggtagtttaaaagtgagaaggaattagtctgcactcaagagggaataggtaaggagaaaaatgaggaggaggtaaaaatccatgggacttggcaatctgatcaaagagaatactgagggttttagcttggattgatttttctaaagaattcctaaacaactttttaccttatactttaccattagggctgacagatgattataggctagcatttgtctgtgtcattagatgctcacagtctcctttaatattttaaatactgctcctcactcaaaattaaatacccattcagttatgataagaagacagaacaggccagctcagtggctcatgcctgtaatcccagcactttgggaggcccaggtgggtggatcacttgaggccaggagttcaagaccagcctggccaacatggtgaaaccccattgctactaaaaatacaaaaaaattagctgggcatggtggcacgtgcctgtaatctcagctactcagaaggctgaggcgggagaatcacttgaaccgggaggcagaggttgcagtgagccaagatcacgccactatactccagcctgggtgacagagtgagactctgtctcaaaaaaaaaaaaaagaaaacagaacaaagaacaaaattacccatacagccaatcaccagttagtttcctttgcctctgtttggttctttgctatgttttggccaaggagatagagcgacagtgtatgcctaggggaaatccagtataaccaatacaaagatgtcttcctcaaacaatagagtaaaacaaaacaaaaaactatttaaaaacaagcaagcaaaaactttggctgaaatacaaaatttttataaaattaaaattacattgcatatcaactaagtttttcatgctaagtgctcctgaaagcactcttgtaatagaaaagctttttgtagtcctgagaaacagggataatttggcgcttgagtctattttcatcagcacatctgagtatggtagtttatattcaagattcacatttaattggtccttgccacccataaatttatactttaccagtttgatgtgttggaatgcagcaaacattcctaaataaatacatgaaatcattttttgtcccaccttataagtgaagtagattccttattctgctcccaaataaagcagtctactaaagaactttaaaaaataaataagccaggcgcaatagctcacgcctgtaatctcagcactttgggaggccgaggtgggcagatcacttgaggtcaggagttcgagaccagcctggccaacatggtgaaaccccatgtctactaaaaatacaaaaattagccgggtgcagtggcgcatgcctgtagtcccagctactcaggaggctgaggcaggagaattgcttgagcccaggaggtggaggttacagtgagcagagatcgtgccactgtactccagcctgggtgacagagcgagactctatctaaataaataaatggaatgaacagttgccccattgctgttgtcttccaaaaatggtaactggattactggtgtacaggcgggtatgtgcacatctgtgggtcaaattgggcatctctggttctctagggggagccccaaagtaagcctggggtagaatcggtatttggatataatggggatgtcttaggcaacctctggccccctctgtttaccagcaccacagtgcaggggttcagcagtaatgttggatcattggcattcaggcacataatagtagttcattaaatgtttgtgcttgaccagccagacttattattgtgaaacctactgagacactgcaactccggctttatgggtagctcagtttatatgaggacaactaacctagggtaactgctgcttcatgatttaaaattgaatggatctcttttggtaatgtaaaatcaaactgcagcaagtagccctcaagctgaactctgaattatacagttgcttctaaattcatatgccattttacttattctttttgtcttaaaggcattttttgttacaaatgtatttttatataagagactctaataaacagtgtatttctctttagcatacaaacgactagatggttcaactgaatgctgtaacaatcacagcctcacagatgtgtgcttttcctacagaaataattttaataagcgtttggtaagttgtccctgaagcagtcttgcttgtctgatataattactaaaaaataagcatatagagctaaaatggaatctatggaaacttctctcttttgctctatttgtatcattttattaaaatctctacatttcacatgtcacatttcatctgaaaatctttaaaaatttatagtgataatatcttatttgacccaaatggggtacttgaatctattttatagtagatgcacataaatggcatttcttttatatgaacctcattcctgatatgctaggtgacatgaaaaatattgaaggaatgtaacttaggtttttcttaatcatttttaatattgactgattaatattttatttatagcatacatgtcttcctgcccggaaagcagttgaagcaactcaagtttgcagaaccaataaagactgtaaaaaaagctcaagttcaagtttctgtataataccttctttggaaactcacactcgcttaataaaagtaaaacacccacctcagattgatatgttatacgtaggacatcctctgcatcttcactacacaggtgagtatttttgtggtagacccttagaaaatcattaagatcacatatagtctcagtggtagagactcactacaaatccttgaattaatacatttattataaatttgatcatttatcaaagtcttgttaacttgttcttaagcattaagtgaaaattatgcagtaggaaaataatctgaatttataaagtaaggtggagctgaatccatgcctgcctatggagagtgacacatttttccttccctaccatttatgcccaggtcaaataggtgatctctcagatgtcctctgagagtttattaaatttatacaagctccccaaaacaggcaagagcaacataccctagagaatgccaggatgcatggggatgtaactgtaatttatgtgtgacacatgattttcatatgaatatactttcaaaactgggccagcataatcattttagcagtggcagcatcattggactaagttctttatggctaaagatcatgtagtctaactcattttgttgtacaagatttttaaaatagtttaccatgcgatttacccattaaagtttacagttcagtggggttttgtttgtttgtttgtttttgttttgttttgagacagattctcactctgtcgcccagactggaatgcagtggctcaatcttggctcactgcaacctccacacctcgggctcaagtgatcctcccacctcagcctcccaagtagctgggactacagacgtgttccactgtgctgggctaattttttgggttttgtagagacggagtctcactttgttacccaggctgatctcaaactcctgagctcaagcaattctccctcctcagcctccaaaagtgctgggattacaggcaagaggcactgtgcccggcccagtgatttttaatatattgagttgtgcaaccattaccacaagctagctgcagaatattttcatcaccccaaaaagaaactccataaccattaagtagtcactccctgtatctccccaacacccccagcccttggcaatctccaatctactttctgtttctataaatttgcctgttcttgtcatttcatataaatggaatattttatgactagcttctttgatgtagcttaatgttttcaaggtttatctgtgttgtggcatgaattagtacttcattctttttaaggccaaatgatattcctttgtatggatagaccacattttctttattcattcatagttaatggatatgtgggttttatgttattctttttttttttttttttttttgagacggagtttcgctcttgttgcccagcctggagtgcaatggcgcaatctcggctcactgcagcctctgcctcccgggttcaagcaattctcctgcctcagcctccagagtagctgggattacaggtgcccaccaccacgcccagctaatgtttggtatttttggtagagacagggtttcaccatattggtcaggctggtctcaaactcctgacttcaggtgatctgcccgccttggtctcccaaagtgctgggattacagcgtgaggcaccgcacccagcctatgtcactctttaaaagactctctcattgctccatagtcatatcctgagatacaaccgaggtcatttttcttatctattagtttgacactaaattactgtagactgtaactatgaaataaaacctcaacaaatgaataaatgtccctagtgggggtaattcaggaatgtgtactgtgagttctgactaattacaggatagttttaaaatgttttgaacaaaaacaggattatggaatccacagagtagatgagactttaaatcccctcatcttaatccttggtttagccatgaagaaaaaaaaaagacctgaaagaggttaagtagtataatagtaggagtaaatgtaattttaaggttatacctctttgaaagggtaaggactcttaatgtaaatttcttactctcgcctcaaaatgtaagtacacactgggacgtattttttcattctgctgtttttattagatgttctagaagtattgattgcttttatatatgaggtatatggcctgcatatgtttaggaagggctttctcaatcagtttaatctgctagcccaatttttaaccatatggtagaattcataatgctgttgattctctggtatgaataatatttattattccttatttttctttttcagtgagcatcaccagttttatcccacgttttaactttctaagcatagatctgccagtggttgtggagacatttgtcaagtatcctttctggtgtgaaacatgttttaaaagtgtgttacttggatcttgatcaattttaccttgaatacagcattacaaatatagacctcacaagtatcacttaattgctaacaactaaaaaagagtcttgaaagatgaaaaagatcagattgtacccaggagggaagaagtcagaggagaaagattaatcagagtgagaaaggtttagatgtagaagggaaagaacccagaatacaaattgagaattgaatttacaagtctaaaacattttagtaagtttataaaggatggaagcttcagttactactgaggtaatgaattctgccccatccgagattgttagttctgaccaaatagagaatgtaatcgcataaccaggaattatgtaaatcccagggaggaatgcacaagaaagatcgagctggtttcaactactaagatagcaattcagagggccaaatcttattgtggtctttcgcatattatgattgcacataaaagatgaattttttcatattaattattatgcagaattgaattactggaaaattgtggaagagttctttatttttgtcgcttttaaattttttaatgtcgttcctcaattatttaaattaaaaaaagaaatggaaaacaaatgagcagttatttttaaaaaatgtgtttaatcaagattgtggccaggcgcggtggctcacacctgtaatcccagcactttgggaggccgaggcaggtggatcacctgagatcaggagttcaagaccagcctgaccaatatggcgaaaccccatctctactaaaaacacaaaaattagccgggtgtcttggcatgcacctgtagtcccagctactcaggaggttgagacaggagaatcgcttgaacccgggaggcagaggttgcagtgagccaagatcgctccactgcactccagcctgggcgacagagctagactccatctcaacaacaacaacaaaaaagattgtactttatagactctgcagctttgtcacaaagagacttatgctataaccttacagagggtagtaaaataaagtaggcttcaaggaccaaagtctttgtttcctaatataaagtaatactttgtaaggcccaaagagtaattttccccttatttcttattccttccacattcctttccctgttgtatcattaaaggattagaaagacttagtcttcctacgagttcattatagattggcttagtttataagtggttggcctttatttttctagtcaaggtttttgaactttgaaataatataaactcattttttttaagtagtagagatctaagaaggaatggcagagatttaaagaaagtagagaagtcaagtgtaatctctaattcagtcacagtaaaatatcttctgactcatagaaatatggtttctactcagacctctcacagttggttccttaactgattttaacccaggtacctgatttccctctcaggagctctggctattgttaatgcagtaccctgctttgctttggatggacaatggattctaaactctttcttggatgccacccttacctcagtgattggagacaatgatgtcaaagatctaatagggtttttcatcttgctgggtggcagtgtacttttggctgccaatgtgaccctgggactctggatggttacagcacggtaatgtttgcactcatctgacagaatccctgagttacagtatacagctatgtggtaatattcattgccattgaaattcttacttggtatgaaatataaagtgtttccttaaaattacatcttagccaacaaccctgagctcctcccatatccagagtacccaaactctgtggtagaagataagcagaagaaatgaaaggcatagtccctgactatattctaatttaggactgaatgtacccagatgcttgtggaataatatctaagcaagtgcaaattcatgtaataccgttttgtctgattacatattgtgttgaaatagtataaaggagaacagaactgggtggaattaattgggaaaaacttcttacaaaagcatcattaatcaaaatttgaaggagaccagactttggccaagtggaaggatgaccattgtcttggcctgtatctcttgtcctttgtcttgtttgaaaagtattttaaaacttaatggtgtattattttgtgctctgaaagctgaggtctgattacaattagtaaaattctatagaagaatctgctgacgtgaaagggaaaaatctttgtcaaatgataccaaataaatgaacaaaacaggaagtagggcctatgatatcgtgagacatgttttgccccacaagagttgcatcttttataaggtgtctctgccccctcataaagcagcactagctttgacatccacggtgagctgcaggaagcatcacacaccagcagcatgtgagcagagggaggcagttggggttgaacttcggaactaggccgggtctcctgacagatcacaagacaccccagaggatcttcagcagtcctacttcccattctctatagagctttgaagcttggaacccttccagggtaaacattttctcttgtgctgctcaggacatctggggcctagctcctgggttcctgtctccaagaagcaatgaccttaaactctgagccatactctgtcctcaccagcggctcccatgtttttctgtgtcaggttattaagtacctagtccttgttttctgtctctctcctaagctacctctctgggtccacagaagacttggtagtatagtgagaatggctatacgtgagtacaaacgtggattttccagggcttgggaactgattcttgagcccagaagagccacgcctgctttgaggtcttttggagtggagatgcagccctgggaaatttggggagtcagcaggccagtgtgaagctattggtcctaggagtatatgagcttgctgtttctttgatggaaaatacatgcttctcttgtatactcagaagtgactaagggcaataactcattaatagccatctatccaacttctttactgagtgatgtattccatggggttacctttttcagattattgagttgctctgtaagcactaaaactttttaatcatttttaagaaactttttagattgtattacaaatttgccttaacagtaattagatgttgaatataattttaacattttattaatgacttgggtcatcagttaataccagtactaaaaccatacgaattattggtttattccagaaaatacagtatttgttctatttttaggtagacaatcatttgggatcagagtacattagcatagtaatgctcagtcagacctgttcaagtagtagagcttggagaatgccatgaaatacttatataattaatttgattgcatgaactaagcaattttactaatgaaaaggttgtatatgtgcaagtcacttttttaaaaaccaagaaaaaactttaatagaggaaatcttattcattaatttatttttctgagtaaaaaaacgaaacccaaatctcattttatttcaactgttaaacattttgatctgttgacccataggatcaggatttgggaaccactttactaggaaagagcagatcagtaccatttgtataaaaccggcctcattatgtaagaaagaaaatgttacgtgttttcttctttagcttggttgtgggcacttctacagcaaggaccatatcatattcatctttgcatccctggcacagtgcatgagacataagtacttaataaatgcagttgaatggataatgattagtgttatttatggattagaaaaagcatgtttctatttaagtaagctgtaaaaagtattattgaatatttactgtaaatatatgttcacataaaaaaataacttggagggtctttgtgtccctggcatattatcatcttcatggaaagaatccactgtggtttctgtagagtgattggaaaaatggattattttgaggattgaagaaagtgttctttctgcgttgtcactttgttcaacagtaaaactttattctcagtgttcctactctgcattgtttacatttttgacagttttttttaatcacctacaatctgtaaagaatgtatatattcttttcagcatctcagtttgaaaagacatgcagttaaacttgaccttttgataatcgctcttacaggtcattgtctgttctaacagcaaattgtaaacatgtgcttcatagatattgtggctctcagtcatcactttgtcctatggtatttattgaatgttcacatactaatggtgcacaggtgtttttttctataaatcttctgactgtcctgtaattcattcttaagctttaacttgaaggtatcgtaattgccggcatttgatgtttagcaataaaagaataaatgtgtaccagcattttatgtttatcatcgtctatgtgttgtcttttttgaaactcttttctatcaaaattgttcctattacataaagcaagatcttaatcatttttaaattcttgattctagaaccagccttcagttttcattcgtataatctatacctgaaagtcgttgcaggccttgaaaataagtcttttaaatgaggctcctgtgcactcgctactgtcttggaaatggctggtttatggataaagaaagaggactatcatgtttcctttcattactgtgtctgacagaaaagtctgctgtcagttaggaattcttgaaagagaatgttttaactatggcatttggttcttcttgaccttttgccctagtgcttcctcccatactctctctctctctttctctctctggtagtaagggccagataaaataggctaggaatgtagcccagtttttgactggttagcttcattccactacttcttgcctctgatcccattacactacagttaagagccacaagactagatgactgattaagccactttttaacagctttattgagatataattaaatactatcaaattctctctttatgtgttaactttgaagtatttaattccatgtaaactatttttctcttaatgtcggatcaaacagtatgcatatgctttcgtataatctaactttttaagtaaatgtgcatgtgataaaagactgggggggaatgtgttttagttatttcacaacttttttaactctggaatggttttcagcaacgtaatagagttgaataacagttatttttaagcatgtaaatatactttctttgagacaataagcctttttaatcagtgcatttgcaagctactcttgctgttggggtcatactaatttgaataatccattgtatattttatcagaccatgacatatgaattcaatgaaaggaaacgcctctgtttcagaactcagtgctacaataagttatacttggggtggaggtaggaaaaaaatggctaattacgaagcaggttatattgtataatttaattttccattaaagggaggaaaaaacacccatatatgttagttttatttagctaaagattgatggatagtcaataattgtcccttcttattaactgaatgcttctcaaacttttctactgacatgctcctgacactgtagaggagggaaaacctagaaggatctaagagtagaaccctgtaattggctctccacagtataaaattgaactctcactttatcttaaatttagcatcctattaatctaatcaagcattctaaagctaattctcttaaagatatggaactctaaaagaattagactctaagaatattaagaatttcttcatttctaaaacacattctggtttgtagactagtgacagtctatggtggtatttttgtccatccaaagtgaaatgagaaaaataaagatcgtgtatattgtctttaattacaaagtaaacataatgtttgtgtaatgttataaggcttcctgctgccctttatcaaagagccccccctttatttggagtatggaaacacatacttggtttcccttagcactgctagattgccctccaaaaatgtctttttgtaactgaccctcttactggcaaggcatgagggttccatgtttgcccacacccttgcctccatctggattatctgacttccatgttctgacaaatctgttgggtttaaaatgacatttcaaaaaaaaataacatttcattttaatttgcatttcttagattattaatagagttgcacattcatatacttgtttagccctttggatttttcattctgccacttgcttattgatatcctttgcccagttttctattgtgtgtgctaactttttctgtttgatccatagaaatttcttgtatattctagattggaggtcaacaaattatggcctgcaggccaaatcttgctcactgccaatttttgtacataaacttttattgtgttttattggaacacattcattcatgtatttgatggctgcttttgtgctacaatggctgagttgagcaggtgcaacggagatcatataaccaaaagcctaaaatatttgctatgttttacaaatattcagaacaacccatgttccagatatcagtctacttccagaacaacccaagtcctagatatcaatctcttgtccattgtagatgctgcaaataacttttcccagtttgtcactcgtcagtaaattttatttatgaggttgtttgttgaacaatgatctttagtttaatatagtaagatcccttaatttcttgagttattgtttgtgttttgtgggtcttattgaaaaagtcctgtcctgtcccagagtcacaacagtattcgcttacattttcttctatttgctttaaagttgtactttcatgatgagatctttaatttctggaatatatgatatgaggtagggaatcgaggtttatttttctatatagacttaactatccttaaaataaacatcatagtattttcttttgaagactattatatacaacagcttacataaagtagttaatatggtgcctgggatgctcaagtcattactggtattatgaacttaaagtacttattttcagaatgcaggattaggacttaatttgccctgagatctcagtgtgtactggtgttagatgttgcctccttttgatatgccttctaggcttccagtgccttcaagctggttctgattgtccagagtatcttgcaggccttggctcttttaagcatttcttcccccaatcaaaatggaccaacaatcgcagtatttaagcaaatggctaaggattttgcttcctgtaactagtgaaaataacctgtgttcatgagtgtatttgctgatagtaacataggccagcatttacatctggtcttatgaaaacagcatattaactcagaaggaagcactatgagaaaccaatataggagagaattcaggataggatggcctttgaagccaccaaatcagacaataaaaaactttctactctgcgcatggtctgggatcttatatttcaaaataatctgttttttacatgttcattttaatttgcattttgttgttgttagaaaagaggctaaagtttttaatttttttcgagacagggtcttgctctgtcacccaggctggagtgcagttggcacgatcacagctcactacagccttgacctcctgggctcaagcaatcctcccacctcagcctcctgagtagctgggaccacatgcacgcaccaccatgcccagctaatttatatttttatatatatatttatatatatatatatatatataatgttatatatatatgtatatacgtacatatatatacacacatatatatgtgtatatatatatatatattttttttttttttttttttttggcagaggccttgctgtgttgctcaggctggtctcaaactcctgagatcaagtgatcctccctcctgccttggccttgcaaggtcccaaagtgctgggattataggcgcactcagcttaaacttctttgttaaaatgtgtgtgctttagtagattccttatccatatcctttgcccgttatttcccttcagtggttgtcaccttcttattccttttcattgttcaggaatcacatttttacaaaggatttacaaacatatttgaccataccttacagttccttggctttcatactttattcctagcagtcttttcttacctttgaacctctttgtttccatcttttaatggcttctacttttttcctagcctttatgtattaccagaaatctataatgggaggtagcactgtgcaatttataacatattcccttctccagtttagggtaccccttttctgtcgaggaaatacctagggaaaagaagttagaacagaaggagataggcctttatagaaaaataatttcttatcagaaaataaatacactttttttttgtttttgtttttgtttttgagacggagtctcgctctttcgcccaggccgaagtgcagtggcgcgatcacggctaactgcaagctccgcctctccggttcacgccattctcctgcctcagcctcccgagtagctgggactacaggcgcccgccaccgcgcccggctaatttttttttttgtatttttagtagagatggggttttaccgtgttagccaggatggtcttgatctcctgacctcgtgatctgcccgcctcggcctcccaaagtgctgggattacaggcgtgagccaccgcgcccggccagaaatacactttaatcacagagaacaggttaatgaaaataaattgtgatttattgaaaacaaacagggttgtattatgcataaactggtaagccagtgtttaaacttgacaatatattacaaacacttttatgttattaatattctaatgttatttcagtggccatataatattgcagtgttaaatatgccgtaatttaatcaacccctattatttctaattttgcatcattataaataaaactgttaggaatatccttacaactaaatctttttgcattctatgactctttagacaattctagaaactcttaggaaaatcctaaagatgactttcttaaagcatgaacagttatatatatagtatacatttaattttttttctgttagttgggtatccgaagatggcatcttgttttaatttgtactttttgatttttaaaaaaagttgaatattttaaaatgtgtttattggccattctcttcttttttttaatccacaacctttgcccatttttcatgtgagggattatctttttactgcttttcctcgtaagctcagctatagcattcaatttgttacatgtaaatatattaaaacttcatttaagtataatgcttatttttgttttcaatatattattgtttgtcaatctttgttttgtttactgcctttggtgatatgttttggaagtttcccccactccgagattttataaatattcacattttcttgtaataattttgtgatctaattttttaaaatatttaactctttaacccacatgggatatattttcatgttggtgcaaagtagggatataatcttatgttttgttttcctcaaatgattggccagccatccaaaagagacggctagtcttcatatgagaggcaactatttattaatttacttttacaattcagtaatacaatgaaatgagtatatacctcatgtgtttcattagaatagagtgcttaaatctttttttttcctttaggtggctttttttttaatggaaatagtgtttctcattcctaaacaatatagactagcaatctggagattacccttaacatatatcattatctaaaggtacggttttcaccaccttcttaattaaaatattttttgcttcatagattttcaagctttaactcttctatctatctctgaatcatttactattcatttttaaaggttaaaaaggcaatctgtctttagaacagatatcctgattttaaagtaagtattttatcttcatctgttttcgttatataacgattaagcatggaacattgcatttcttgattacttgttcaaatacatgcattaatttttattgtcataatttaaatcatgaaaattaggggtaatgcagatactatgaatttgtattttattataagatttaaactgttttttctatttataataaatgatgagtttaaaagaagttggttagctgtgcttttttcctatttgaaatgtttttcttctgagctcactgtagttggtttttaagcttgtcaaactttagaatatgagtcttacacatatgatacactaagagatggctattggttttaaaaagttccgtttttcatattcatgcctattctttaatcactggaaccaatacataaagtctttcattcatttaacaaatgtttattacacaattattatgtgccaggcactgttctaggctctggggatacagcagtaaataatataatttttctcttttgtattttgtaagaaaaaatcccatttgtttttatacgttaaggagagtctgcactttagcctcatcacaaataggaagccattgaaaatttcaagcaagatttgccttttggatggatcatctcagctaaaggtaaagcatgaatgggagaatagcaagtctggtagcaaagaaattagttagaagactatttcacagctcggcgtggtggctcgtgcctgtaatcccagcactttgggaggctgaggtgggtggatcacatgaggtcaggagttcgagagtagcctagccaacatggtgaaaccctgtctctactaaaaatatgaaaattagctgggtgtggtagcaggcacctataatcccagctactcgggaggctgaggcaggagaatcgcttgaacctgggaggtggaggttgcagtgagccgagatcatgccatttcactccagcctgggtgacaagagcgaaacgccgtctcaaaaaaaaaaaaaaaaaaagactatttcagtaatcttcaacaagagatgacagtgatggcgaatacagtggtggcagtagagatcagaaggaagaagagaacaaaccaaaagtagactccactgtatttgatggttaggcgtgtattaggttcaaggagtcaagaaggcaatgaaatgatggaaatgccattgacagagctagggaataccagaaaaggagcagttcaatttggaactccttttttttttttttttttttttttttgagatggagtctcattctgtcgcccaggctggagtgcagtggctcgatcttggctcactgcaatctccacctcccgagttcaagtgattctcctgcctcagcctcccaagtagctgggattacaggcgtgcaccaccacgcccagctaatttttgtatttttagtagagataaggtttcaccatgttggccaggctggtcttgaactcctgacctcaggtgatctgcccgcctcggtctcccaaagtgctggaattacaggtgtgagccactaggccagcctcaatttggaactctcgagtttgaatacctgagagacttccaagtggagatggcgagtaggtagttgtatgtacagatctggaacttaggagaaattagttggagatgccatctgtgagttgatgcaccccaaatacataattgaacccatggaagtgcatattgtccagcaaaaacagggaaaaatgaaaagggaaggtgtcctaggataaagatctcaggaataacggcatttaagttaaaaaaaaaagtacaggaataggaaacaaaggagcttcagaaaattagaaggaaaactgtaagagtttggtattagagaaagggaagagaatgtgtcaagaagagggggatgtccataatatgagatgttgctgaaagagaaatgatgtcggatgaggactgaaaaatatccatgggttctagtagaacagcagtccccaacccttttggcaccagggactggtttcgtgggagacaatttttccatggaccagaggtgggggatggtttcaggatgattgaagcacattacatttattgtgcactttatttctattattatggcattgtaatatataatgaaataattagacacctcaccataatgtagaatcagtgggagtcctgagcttgttttcctgcaactagatggtcccccgtctaggggtgatgggagacagtgacagatcatcaggcattagatgctcataaggagcatacaacctaggccccttgcatgcacagttcacaatagtgttctcactcctatgagaatctaatgctgccactgacctgatagcgggcagatttcaggtggtaatgcaagcagtgagaagcagctgtaaacacagatgaagcttctctggctcacccgtcgctcacctcccgctgtgcagcccagtttgtaacaggccatggacccgtaccagtccgtggcctgggggttggagacccctgtagtagaagagttcatagatgatcttgagagagaaactctagtgtggcaggagaagttgagccaggttggagtggatgctggatggtggagtgggtggggtgtgtgcgggtagagactgcaaatacagaaaatgccatcgagaagttccatttggaaggggaggagagaaaaactgtgggacctagtgaaggatgtaggagaaagttgttatcattgttttagcaataggagaattgtgtgcatgtttttggtgctaatggaaaggacccgagataaaataattgagggaagagatgggagccagggcacgatagagccttcattaagagggatgccctttctaagaggaggaaaaatggatgcaagcatagttgtcatggttttgatagagaacctcatgtggctgtccatcaaacatcacttgagtcataggtgtctagaacactattttgcaccttagaaatatttgaatagacaccttagaaatctttgctgagtaagacagattcctcgcatagctgcaagaagcttagccaaacccatttctaaattaaaactaccagcaaagaggtacttgagtaataggcacagggtgctcagctctgggctaatagcattgaatgtcctgatttttagaatgttctgtgcttaacttctcaggcaacacaggctgaagtataagagttgaagggatttagaataagtcattgtttcattaaaaattatttttggctgaaggagaaataagatttggatggggacacagctaaatcatatcatataccatcttaattggggatggtattttttttttttcttgagacagagtctcgctctatggcccaggctggagtgcaatggcatgatctcggctcactgcaacctccacctcccggtttcaagtgattctcctgcctcagcctcccgagtagctgggattacaggtgcactccaccatgcccagctaatttctgtatttttactagagctggggtttcaccatgttagccaggctggtcttgaactcctggcctcaagcgatctacccgccttggcctcccaaagttctaggattacggtgtgaactactgcgcccagccaagttcctgaaatctcttatctgtctaaaagcagaatctaccaaaaaacaaaacaaaacaaaaccctcgattgccataaatcccctccctgagagcaacatagatggagatgacaagttggcaccacacccaaacagacattgtcaccaaactcatatctcccatctattctcctaagggttcatttatctttcaaaaaaaatctttatttttccataaatgcccttccctaatccccttctaagaagttattagttctcccagaagtgtcctctgaccctccccatccccaattaagatggtatgtgatatggtttagctgtgtccccaccgaaatctcatcttgaattgtagctcccataattcccatgtgtcatgggagggactcagtgggaggtaattgaatcatgggggcgggtctttctcatgctattctcgtgatagtgaataagtctcatgagatctgatggttttataaagggatcttctcctgtacatgctgtcttgcctgccaccatgtaagacatgcctttgctcttccttcacattctgccatgattgtgaggccttccccagccatatggaactgtgagtccattaaacctctttcctttataaattacccagtctgtccattaaacctctttcctttataaattatccagtctcaggtgtgtttttattagcagcatgaaaatggactaatacagtgtataagccccaaattctaaccacctccttgagtcacatttccttgtgaatttccatgccaaccaacataattaaatgttgctgtctcttgtgaatctgtcttttatcagtttaatttacagggctccaagaaaagaaccaaagagggcagaggaacagtttttcctctctgacagaataaaagggcatgatgtttgaagcttacttccaaatggttctgagagaatgagctaatagagcaaatgtagcaaaacattaacaattgttgaatctgggtgaaggatttgagggagtttttggtactgttcttgaaacttttttttgaaattatttcaaaataaaattatttttaaaagaagaataagcttctgcatttattcatcacctctgctttttttttttactctatttccactttcaacacttttttactcacaacttcctatgagtggaaaggatgaggaatttgaaagacagggctgccttttgggtttgtgcaaaatctctgtgtcttaatttgtctatctgtaaaatgaggataatatcttcaaacgtttgctacatgaactgagatgaggatacagtaggccctcaataaatgttattgcctacccttctaagaccagttcaagtcctatttcctttattaagtcttccctcatcacatccatgataaaaatttattttatatcgtaccatacatttagctaaatggctttctcatacattacctcattgaattatcccaataaccttacaagttaggttatcattttctctacatcatagataaggacatttaatgaagttaaaagatttggctaaaatcacacagtcggtcaatagaaataacagaatgaaaactcaggttcttttagccccaagttgtatcctctatgttataccacaatttgatatttctcctactcaagtgttttaagtgtggtaagaatatacataacataaaatttactatgttaacaattttaaaatgcactgtttagtggcattaagtactttcacgttgttatgcaaccactatccatcactagaactttttcatcttgcaaaaactgaaattctgtaccatttcaacaccaactccccactcctcccttccccccagcccctggtaaccaccattctactttctgtctctatgaatttgactgctgtagatataagtggaatcaggcctggtgtggtggctcacacctgtaattgcagcactctgggaggccaaggcgggagggttgcttgagctcaggagtttgagaccaggctgggcaacatagtgagacctgttgtctacaaaaaaattaaaaaattagctggaagtggtggtgcatacctgtagtcccagctacttgggaggctaaggcaggagcatcgtttgagcccaggaggtcaaggctgcagtgagctgtgatggcgccactgcactccagtctgggcaacagagcaagaccctgcctcaaaataaaataaaataggccaggcgtggtggctcacacctgtaatcccagcattttgggaggccgaggtgggtggatcacctgaggtcagatgtttgaccaacatgctgaaaccccatctctattagaaatacaaaaaaaaaattatccgggtgtggtggcgggagtctgtagtctcagctattcgggaggatgaggcaagagaatcgcttgaacctaggaagtgcaggttgaagtgagccaaaatcaggctacagcactccagcctgggcaacaagagcaaaactccatctcaaaaaataaataaataaaataaaataaaaatttaaaactaaaaaataattatacaaaaagggaatcatacagtatttgtccttttgtgattggctgattccacttagcacgatgtcctcaaggttcatttatgctgtagcatgtgtcttaagttttataaacacttgtgctcatggcactcatgtacaacttcgtgtgtccttattttctttcctggtttataaactccttgggggctgaaatcccatgctttctcttggtattgccacgctcatagtgcctcgttcataacagtgcccaatgaactctcttgaatgggtagatacaggccactctaaagtagaaaacgatccctctcctatacttgatgaaacttgtatacagtttcatcactgctgtcagctattggagacaaggagctggacaagcataattgttctccctactattgaaacgggagccagacgaattaagaagattccccaggttggaagtatgacaggcaggtgaactttagtcaagtagaattagctctctgcccagtgtaaaaacgtatatgcagtattcttcaaagaggaaaaaatctcatcttttagtcatatgaagtgagagagagtttggtcgtggcttttttttttttttttttttccctgagaaaaagaaatgagatctgtcaagactgaactttgcaggagagaaatcatcaatctttggtgtcatctgagtgcattggaaatgcatttgccttgtcttgcggtttgattgttgtctaatccctgtaaacattaaaggataaaaacaggagaaatggaacaagaaatatgtgggatccaggttttagctgtgctgcccgctggtgactttcgaggtgaagctttcaggtcccttctccctagcacacccatgcctccacctctatgaagcaatagagcttcaagggcaaatctggcctcagagcccagaggggaatatggccacatcagggaccaccccaggagactcaaaggcctgcatctctttgtcttgcaggagttgctgctggaccacatgacaccagtcccattcttgaagcagaatgttcaaagagtgtgtacaaaatgcagaagccacccatttccaagaaaaacggctatgcttcaaccagcctaagtctactgcaagcaagggcacccataagagatggaccttgagggattcaacctaactaactgtgagtaaggacgtctagcacattttggagagtactggtatgagacagattccaaataaaataaccggaggcaggctgggtgcagtggctcatgcctataatcccagctcttagggaggcagaggcaggaggatagcttgagcccaggagttcgagacttgcctgggcaatgtagcaagaccccattctctacaaaaaggaaaaaaacaaacaaacaacaacaacaaaaaaaaaaaaacaagaaataactctaggcagcctgtaacatactaaattatttcccattagcacattagcacataaacaccattagcacatctttttgaatatgtaaggtctgtggagataagactacacacaggatctcaaagaatctcccttactaagggggaaatcaagttggcttttatcctagcaacttacttaagccttaacatacttacaattgttttacatagtatataatatttcccatacttgattgtgtttcttaagtttcatttttaattttcaaatcaaaacaggaaatatgggctgggcacagtgtcccacactctcagcactttgggaggatagcttgaggccaagagatcaagaccagtctgggcaacatagcaagactctgcctctacaaaatttttttaattagccaagcatggtggcatgcatctgtagtcccagctactcgggaggctgaggcaggattgcctgagccctggagttcgatactgcagtgagctaggatcataccaacatgctccagcctgagtgagagaggaggaccccgtctcaaaaaactgtcaaaaaaaaaaaaaaaaacagaaaatatagagaagaggtagctatttagaatgcttgtagaacttttgtaacattactgttttttagactgaggaacattctccaaaaatatgattttgcacacacttttgattgcctaaccaaaagtcatttctctctctctttcccttctggcagggcctgcttcccataagaagggctaaaaatgccagacactctctttcagcctcttttgcaggtagggctggccacatgacccatctggtcaaattaacctttcagccacaccctcccaaaaggcttttagaaagatttttcatggtaatgaaaacaacagatattcaaggagagctttttttccccacctcttccttcctgacatttcataggcatttcatttcatgggagctatggaagctatattgcagccattaagcagtagacaaagcgaacgtgctgaggatggcaacaaacagggatggaaagaacctggatcactgatgatgacactgtttagcttgggaccatcaccttctgtattagtcagggttctctagagggagagaactaataagatttatatatatatacataaaggggagttaattaagtattaactcacacaatcaagaggtcccacaacaggcggtctgcaatctgaggagaaaggagagccagtccgagtcccaaaactgaagaactgggagtccgatgtttgagggcaggaagcatccaacacgggagaaggatgtaggctgggaggctaggcaagtctagtcttttcacatttttctgcctgctttatattctacccatgctggcagctgattagatggtgcccacccagattaagggtgggtctgcctttcccagtccactgactcaaatgttaatctcctttggcaacaccctcacagacacactcaggatcaatgctttgcatccttcaatccaatcaagttgacactcagtattaaccatcacacgttctaaacaccttattatgtaaaatgatacaatcctgttggatatgccacctttttttgaaacagggtctcaccctgttgcccaggctacagtgcaatggcatgatcacggctcactgcagcttcaaactcctgggctcaaagtgatcctcccatgtcagcctcctgagtagctggaaccacaggcatgtgccaccatgcctagctaattttttttttagagagagacaggctcttgctatgttgcccaggctggtctcgaactcctgggctcaagtgatcctcctgcctcagcatcccaaactcctgggattttaggcatgtggagccattgtgcgtggctggatattgtttttaccacttttagctggatattgttattcacagctgaaagcaccttaacatattcaatgcgattttaaatacagtccaagtggaacctattttacaccaaatattgactaactttctgtcagacattggaaggccatgttcctaaacataagcatatgagaaaatccttgtaatgatgagataaagggagtttgccagtttaaacacccgcgggttgccctggcaaatgtcaggtgtcacagggtcggaaagattagttcataatgtactaggaaaaacatcctgcaatgtatatgaaaatatatattgtaaaaaatctttttggctaaatgtattggcacgattattagaatacaatctagaaacatttactttaaattttaagagcaaagacaagacttctaatcttaattagtcaaagtttttcttaaggatttcaattcaaatgtgtcctttattctgattgtgatgggacttttgatttctcctatttgaaatgccatgtgaatgtcttagaaaacccagacatctgaccttatattttacttgataaattgaaaaagccacttgctgataaaattttgttattcacaggtattacatgagtgaattcatttttctacttgctagttttctagacaactatcttcattaaaattttagattactgtaatttacatggagttcacacattcaatttacagatttagaatacttaatcaattgatgtccattttattttttcatttagttgctgagataagacatccatttttctcaaaatgtatcagatcaagctaaaaaaaaagaaatgaaattaatatgaaaatatctattaaaggacatcagtgtccaagctcaccatcctttctaactatctttcatctgaacatagtcagggcttatacaatagaattaaatataccatcccagaggacacctggcagtgtccagagacatttttggttgtcacaacatggaggcgcagtgccactggcatccttggtagaggacaaggatgctgctacacatcccacagtgcacaggacaacccccacagcaaagaatgctccagcccaaaatgtcaatagtgccagggttaagaaaccctgttctacaccaagcaccttgatgtctaaaatacaacacaaactggttctttgttcattagaattcctacagaggaaagaatagattactatcattttacagtcatctcaacaattgaagtcaggagaagccttgattcttataaactgcaaaacattagtttgaagtctagtttgtaggtatcatttgttttctatgaggaattccttcttttgatgttatattttctttcattcaaagacaggacttacatgagccttcctttctgctgttccttttcttaaaaaaaaatgtcttatggctgggtgcagtggctcatgcccgtaatctcagcactttgggaggccaaggcaggcggatcacctgaggtcaggagtttgagaccagcctgcccaacatggtgaaaccctgtctctacgaaaaatacaaaaattagctggacacggtggcaggcgcctgttattccagctactcgggaggctaaggcaagagaatcgcttgaacccaggaggcagaggttgcagtgaaccgagatcgcgccattgcactccagcctgggtgacaagagtgaaactccgtctcaaaaaaaaaaaaattgttttatatctagtgtgtcttgaagtgaacctgaacttcactaacattgccaagagtctaccccaagacgtggaccatagatgtgagttcagtataaattatatggctataggaaagtcacttagagaaactttcactgtgcctcagtatctccctgagatgcctgccttgcttgtagagataatgtgaaaacatttcacttggaaataaagtcaccatccaaatctaagatctgatataaaagagatgataaagaacactaagttcacattactcttcctggtattttaaatgtcttttctatctttgaaaagctgacctggaacacagagaagggaattttttttttccttttaaagattcctatggaggattgttctggaatccatcagaatgttctaatacctagcctctaatttgtcataataaggcatgacacattacaatgtagattgataaaactggtttggaaagcaatttatccacactcatcaacctcaaaaatgttcatgcccaatgcctgtagtcccagcaacttggaagcctgaggcaggaggatcgcttgagcccaggaggttgaggctgcagtgagccatgattgtgccactgcactccagcctgggtgacagagcaagatcccatctcttaaaaaaaagaaaaaagttaaaaagagtccacgcccttttaggcagtaattctttttttggaaatttattctaaagttctaaagtaataatcctaaatatatactaggctttctacaaagagatgttcctaaacctgtgatttaccacagtgaataactgtaaactacctaactgtccaacaaccaaaatagtggaatggatacattaaattcactaacttaactcagctttatgtctacatgaacatagtaaaaattatttttatagaatatgtgtgataacatggggaaatatttttattaaaaaataaaacaatatgaaactatactcactacatgattataatagcataagaaatcaagcaaaatcctataaattggtgtaatcaaagctgtgtacccagaaattccacttctaagatccttaatcctagggaaatgattagctacagggattttttttttttctgagacagggtctcgctctgtcacccaggctagagtgcagtggcacgatcacagctcactgcagcctcgacctcccagtctcaagcaatcctcctgcctcagcctcccaagtagctgggaccacaggcaggcaccatcacgcccggctaattttttgtatttttaatagaaagggggtctccatatgttgcccaggctggccttgaacccctctgttcaagtgatcctcctgtcttggtctgctgagtagctgggaccataggcacgttccaccatgcctggctaattttttttttattttaaatagagataggggtctccctatgttgcccaggctggtctcgaactcctgggctcaagtgatcctccttggtctttccaagttctgggattacaggggtgagccaccatgcccagcctgttacagggaaattaatcaccatgcaaaaaagtcgaaacaattttaattttttttagtaaaaaagtggaaacaactcaaatgtccaacaactcaaataataagagatgcgtaaaaatcaattacggtacaacaatacagtggaaagatgagcagccaataaaatgatgttgaaacacgtttattaacaagacaacatgttcataatatattaagtgaaaattcaggcttaaaagggtagacacattaaaaatcccttaaaagagtaggaagaggtaagaatgtgtatgttcagtatataagtccaaaagaatattctctgcaaaagtagctggttgtctttgagtggtagaattataaggagattttttttttcattttgcttgtatgtatttttcgaaatttctgtagtaagcatgaactatctgcataaaaaaagaaatacatcaaatgttatcaaagcctacagaatagaactatggatctcttcttattacattttgtttcctgtattttcctaatggtctttacttatttcacttgagaagaggtgaaccattagaagaaagcactatccggtgtcttctttaggagaaatatcttgggtcagtcactttccttctttaaaatacctgtctcagatgggatagggtaggttatgctgttgtaacaaacaagcccaaacaacaaagatgtatttcccactcatgctacatgtccatcacaggttgtctggcagctctgaccgccatagtgactcagaaccttagtctgtggatcagctaccatgtcaaactgtgccagttgccacactagaggaaaaaagagctctggaaagtcacacatcagcaacaagttgccccagcctgaaagttactcttattacacagtggccacaattagtcacatggccctatccaattcataggaggccaggacatgggtaagacagattatgtttggtgaacggcacctaattcaccagctcagaacattgtaagcaaatattgaaagaactataaggagacatcaacaaatttataatcacagtggtcatattcctggcacctgctactgtagtctgtggccaactttatcttgttagatgcaagcattgtagaaagcataccaatgtgtcagatggagaccagttgccacaagcaaaacaggacatgctttttgtgaaatcaaaaactaacaatgcatttgttgattgtgtggcaaaaagaggataaaggagcatgcaatacatacgcaatatatacataggtgacagcatttcacatttactcgggatatactcagctgggcaaagaaaattgtagctttcatcccttcttggccttttggctaagatcaagtgaaaattgtagctttcttctttctctctgactgctctgatttacctcacaagcccccaccctctaggtagaagtagggaggggaaacaagattgaattcaatttattaacctcaattcaatccctaacttaaaatgtctttgtgggtaaatagtccctacttggatgactcagttaagtgctcaaccagtaagagttccaccccttcctctgctcctttccaagatggcatcaggtgtgtgagggaggggtgtagctttggagacctcttagtggcaaagggcagatgttaatcctcccaaagaaaagcaagatccagacctccccatttgcagtcctctgccttctcagcaacctagctaacatacttcctgccctaggacttcaacctagaaggaagcgatcagaacaactgtgtcttgtgacctgcccccagactgggaagtgggaaggggttagggaggggggagggtttttctctctactctttacagcctgaccatgcctcccttctatcctgcacacaggcctgtgtattgaaaaggaagctttgttatttagaaatccctttctccaaaaagcctgggttttatatatattgttttactcaaaagaggccaagaaaatcagctttgaaattcaaagctgatgaatgggctctgttctagacagcacctgttcgtcctttctttcctgggacaataaccttgatgactctatcaaaaggctagcaggaagtgggatttaaaggggaaaatcaaaatgcattggtttaattattataaaaggtgttcctcagaggcgagattggaagaactaaagtaatgaggtatctattttcttggctgtcttgtgagatgtatctcttttcctcacagagacaaagtaaaattttcaaaaatatgaccctaatgaaaatacagaatgaacacctcactggttttatgcattaatgagggagccagcaggatggtaaatctggtacaaaggagaattcaaaagatatgtttaaaaagaaaaagcatgccgaaataagcttactaagttagaggcaaaacagggcaataaaaccataacctttgaggtcaccccttctactgcaaagaaatcatttgcatctctactggacaaaaacctccaagttaacatgcctgggctttaatcaagcaacagtgcattctcacagagaactgaataatccttgggtgggcgctttaaatggaggccttttaataaagcttcagtctggaaattgaaaggacaagcagtcattctgtctccttgtttccaggtgttaggtaatttttcttaacatactcaaacattgcctacatcccacccaccttaacacacacaaaaccgatctgctgagagctgatggaagaaagagttatgaatggattaaagagcctataggaataaaagatggggatttaaagcaagcacaggtttctgcttcagagacacaagtgaatgggtatctttaaaagcctaaatatgtgattttgttgtaaacctacatattttaaagatgtttaaattacgctttccttttaaaattaccttttccttttcaaaatctagatagacttaactaggcctgaatgattccattaccaaagcagattaatatggttaaatgaaactgtaagggcatgtgataattatttttcagttgtcacaggttacataggttaccatagcccattaatgtatgctagcctattaagttactgaaatgacaaacattattgcatcgataaggcatattcagtccagttgagatagaaaccattctccaaatgatagtagtttccaaaagaaacctatttttaaaaatctcataacagctcatttgtaatacagcttgctgctcagatggtttctgaaaagtatcttcttagagagaaatcaaaacatctcatatactccataaatatacacacctattatgtacgcgtaaaaattaaaattttaaattttaaaattttaaaaaacaaaacagacaaaaaaaagaaaacaaatattataataggacaaagcctactctgaatagcaggttccccatggaattttgttttctgagtagagagcaagatcatctgattaaaaggctcaaattctctgaaactttctattgaaggctatgatgtgtaacatgagcgcatttccatattaaggttattcagctgtggaaaacaccagaacccacacaaagcttttcctttaaaagctgaataaaatctaagacactgcatgttggtgcagaaatgagaaatctaagttgttgttcgctgactgcttggctgtgtgtgttttttttttttttcctgcaagaaagcagagacacacatttgagaaagcattgtaactcaaaagcatgaccacagctaagaaatttaagtaaccatgtcacagaaacacaggaacatagattctgttggctaatctaaatagataattaatcatgttcctggcagtgtggaatgcagatttgcatgctattcacagagactttggcaggcaggctgagagctttctggaatatcagaatctggagtgtcttgaggagctggtaagtcagtcattctgagatctacagatttcttggatcagtaacatttaaaaataatgttgaagaccagcatggtattaacaacttcttattttggcaaataataatattgtaaaaaatacttactatttataattgccattatttcataaaagatatggtttcacagactatttttttaggctagttcgtaattggattcgctgttggatttgggggtcaagatatctttaagtaacttaacttatttctcaaacctttcataagtgactgaaaggcatattgaagtacctgccatgtccagtcaaaatgaatgttacttctgagacaggtgaatgtgacaggactagactggctctagataggagcttggatcttgagagttcttctgtgggatcatcttgtcttaaggagggttttttcaaatggtggggagataggagatttaaatattgaccaaattccaactgtggcatgttttcagctttcttctgccctccctgacctgtaaataagaattaaatcaagtaatactgcccaaatgcctattactaacagtgcagggttaagctttgggacaaaacttctcaaacttaagtcttcataagaatagtctgagaacctatcaaaaggcagattcctgggtcttagtgccatgggttctgaagtctgagatggcaaccatggaatctcaatttttaacaagcataacatgattttggtggaaatggtccgtgggccccatctttagaaacattagcctaggagtgaaaaaaaaaaaacacttccaatttctgtaatgacatactaggtattcagaccaactttcttgctgaacataatatgttaaacctcttcttaaaagcatcaaaaagctaacaaaatagtgataaattactgggatgcgattcagaaaagaatggaaatccacagaagtgagcctgacattctgaaccacttttgccttcccattactagcagatcctgaagagacaactgagagggtgagctgtcttcttagcaagctcatgggaataggaaggcaaaaatcagacatcgggacctgccaagggttgacacatggtaaaccagtcctcgtcccatacacatgcacacacatgttaggaggaagggtgaactggaagtggcttgctcagagaatctcacatcttgaacttggactagggtgatcaacttgggcctcaaattattctgacaaataatttttcttatatagtgcccagcacacaatcaaagataaccaagcctaattgggacagaaaaccttgagcaagaacctctaggaaaaatgaacaacaaaatggatttagaatgactccagatatgagtaaatctaaatgagtattaactatgtgaaacaattagtatagtcccctgtgggaatacatagatagatagatagatagatagatagatagatagatagatattttaaatgcatgataatcatagtataaagtcttgagaggaaaataaatggagataaaaatgttctaaattcctaacattatccaaaaggagaggaaaggtatcaattaaagttagatatttggctgggtgtggtggctcatgcttataatcccagcactttgggaggccaaggcaggagaattgcttaaacccagaagtttgagaccagcgtaggcaacataatgggactctgtctctacaaaaaataaaaaaagttagctgagcatggtggtgcacgcctgtagtcccagctactcaggaggctgaggcaggagaattgcttgagcccaggaggtcaaagctgcagtgagctatgattgtaccactgcactgcagcctgggtgacagcaagagaccttgcttcaaaaaaatgagatatttaggccagtcgcggtggctcacgcctgtaatcccagcactttgggaggccgacacaggcagatcacctgaggtcaggagttcgagaccagcctggccaacatggcgaaacaccgtctctactaaaagtataaaaattagctgggcgtggtagcaggcgtctgtaatttcagctactcaggagactgaggcaggagaatcgcttgaacccaggaggcggaggttgcagtgagctgagattgcgccactgtactccagcctgggcgacaagaatgagactccatctcaaaaaaaaaaaaaaaggatatttataagtgaaacatgcatgctgtaattctaggctaaccaccaaaagaataaaagaagagtatatgatgtataaactgaaagagatttttaaaaattgaatgtaaaagtcatcagtccaaaagagggtgaggacagaaagaaaaagaaacacaaaacaaaacagacaagaaaagaaaaagtacataataataagattttaacacaaatatatcacaattacattgaatgtaaatggactacattttccagtgagaaaacagattataaaatagaaaatagacaaacaagcagtactactatgtgttgtttaaagagacacatttaaacgtaaaaataaagaaaggtagaaagtaaataaatgacaataatttactccacaattggtaactgaaagcaagttgatatagctatattaatatcacacaaaatagacttcaagcaaaaagcattattagaaataaagcaagtcacttcttaagaaaagttaaattcactaggaagacagaacaattttaaatttgtgcataactaataacctggcctgaaaatatataaaataaaaattgaggctgggcatggtggctcacacctgtaatcccagcactttgggaggctaaggtgggtggatcacctgaggtcaggagttcgagaccagcctggccaacatggtgaaaccccgtctgtactaaaaacacaaaaattagatggatgtggtggtgcatgcctgtagccccagctactagggaggctcaagcaggaggatcacttgaatgcaggaggcggaggttgcagtgagccaagatcatgccactgcactccagcctgggcaacagagtgagactacatctcaaaaaaaaaaaaaaaagaaagaaagaaaaacaaaattgaggctcatacctgtaatcctagcactttgggtgatggagaaaggagaatcaattgagtacaggaatttgagaccagcttgggcaatatagcaaaaccttgtttctacaaaaaaaatttttaaatagcctcatgtagtggcatgtgcctttagtctcactcagctactcggaaggctgaggtgggaggttcacttgagcctggcagcttgaggctgcagtgagctataatggtgcactgcactccagcctgggtgacagagtgagaccctctctctaaataaataaataaaaataaataaaaaataaaaatttataaaaataaaaattgataaaatcaaaattaaaagtacatcaaggagaagaaagaaaacccccagtcattgtgagtgacattaatacaactttcttagtaactggtggaaccaataaacaaaaaaaagtcaaaacacatatgtgtactctacacagccgctacaggtacgaccatgtgaaatagtagacaaggccaaagtccagggaggatcatgtacaagggaattcctcccagagggcaggaccaaggtctgacaggagaacttccttcactactagggagtctttgcgcatcttgccaaacacgatttcgtcatttctatgcaccagtgactgacgagtgctttccattctacattttcccaaatgggagttttctctgtgtctatcctgttcttgctctatatgatgtgccaaatgttgagtagtgttgggggagtaatgttctattattatatagatttctggatcatgagacagtagatctagacctgatagaaaagactgcacgttacacagaggtgtcagactttgttttgtactcaggaaatggatcgtactttgagggatgagtgtattctgtgtgtatggatatttagatgccagaggtttggaagtgtcagagtttgctaattgttccctgtgtccattttgcctttctactttttggtaacagaggccccctgcatgtgagctcatcacatggctgcccggcaagatactacattttccagtcttccatgaggatagatgtggtcacgtgactgagtctgggccaatgggatgtgtgtagatgtgatgtatatttatctccataaagatgaagctggttgccctgaatattctgtccatcagttgggaagtggcaatgaatggaacaatgccttgggccccaagacggatcctgagtatggcagagctgcccaccagcctaggttcctatatgtcatcatgggacagagctgccttgtagaccctggactgttatattaatataaaaaagaaataaacttctatcttatataagctattgtactttaggattcctttgctacagcaacattgcctgtaccctaactaatacatgtgttatggagtgacaaaggtcagttgggaaggtgggggtgaagaggaaacacttgttgttagccttaatagtaaactcaggagtcaagatttgacaggcttggtaatgtgaagcattgccgagggacagggcagatggtggtgccattaatggtgattgggtagctgatgaaatggcttcagctaccttttgtgtgatgtttgtaattccacatctctgggcaattctctccagagtatcatgtccatatctcccttgagatcaaataggctcctcaaactcaacatttctaagcttagctttcttctccccaaagcctttccttcttcctgtattttctataaggttaatgactgtacctttcaatatcacccttcacccacttgtcagtagaaactagaatcacccttgattcctcattcatcaccacacagtgtctcataaacaccacctacttctattctttttcctctattcccatcgctagtgccttaattcaggtcttcattatctcttacttcaaatgttgcagtagtctcctttctttttttctgtttctttttcttctttttttcagcattcttctttctagctgatttctctgatttcaatctcccccatgcctcatactgctctcaggactctttttccaaataacaaatttgatcatgtcacttaccctgtttagacatcttcttcgatttctcaattttctttttttgagatggaggagtctcactctgtcacccaggctagagtgcagtggcgccatctcggctcactgcagccttgacttcccaggctcaagtgatcctcccacttcagcctccctaggcacacgccaccatgcccaactaaatttttgtatttttggtagagatggggttttgccatgttgcccaggctgttctcaaactcctgagctcaggcgatccacccacctcagcctcccaaagtgctgggattacaggcgtgagccatcgcacccggccatcttctccaatttcttttaagctaaggagcctggactggtcccctttgaacccttatcaagcccctcagtacactgtgggccccaggcacagtgagcctttatagacaatgtcctctctgcctggaacacttttactctgtcttcatttaacagactcctactctgccttcaaaacccagtttaaacataactcaatgaagtatcttctcaggccaggcagggtggcacactcctgtgatcccagcactttggtaggccaaggcagaaggatcacttaagcccaggagtttgagaccagcctgggcaacatagcgggaccacatctctacaaaaaatttaaaaattagccaagcatgggggtgcacgcctctagtcccagctactggtgcggctgaggcaggaggatcacttgagcccaggagatcaaagccgaggtaagctgtgagcatgccactgtacttccagcctgggagacagaatgagaccctgtctcaaaaagaaagaagaaagagagaaagagagaaagacagacagacagaaagaaagaaagaaagaaagaaagaaagaaagaaagaaagaaagaaagaaagaaagaggagggagggagggaaaggagggagggagagagggagggaaggaaggaaggagaaagagagagagagaaagaaaggaagaaagaaagaaaaagaaaagagaaagaaagaaaaagagaggagggagggagggaaggagggagggagagagggagggaaggaaggaaggagaaagagaaaagagagggaaagaaaggaagaaagaaagaaaagaaaaagaaagaaaagaaagagagagaaagagagagaaagaaagaaggaaagatcttcccagaatcccttggcttagttgtttagctattcccacctcaatatttgatatatgaatgaatgaattaaagatacattaagaaccaaatcctggccgggcgcggtggctcacgcctgtaatcccagcactttgggaggccgaggcgggcggatcacgaggtcaggagatcgagaccatcctggctaacgcggtgaaaccccgtctctactaaaaatacaaaaaattagccgggcatggtggcgggcgcctgtagtcccagctactcgggaggttgaggcaggagaatggcgtgaacccgggaggcggagcttacagtgagccgagatcgcgccactgcactccagcctgggcgacagagcgagactccgtctcaaaaaaaaaaaaaaaaaaaagaaccaaatcaaatcccaaagaacacacccagcagaaagacaaaaaatttccaaagtatagaaatttaccactgcaaagggagcttacagattgtaaagatcatctaaatgtgtttacaaatgaggttcagagatattatgtgactatctcagaatcagacagggtctgactatgctgcccaggctgaaatgcaggggctattcacaggcatacagcgcactacagcctcaagctcttgggctcaagcaatgcttctgagtagctggcactgcaggtgcacatcattgtgcctggctcttcctgtactatttttttctgtattttgctgtgaatgcattagagaataattttaatagaaggatttgtttgaaaagctgaatttaaaggttcgatgcttcagcttgccaacaaagttgcacttcaagtcaaatatgaaatgatcaaaatgtcagtgtgatcttgtcacaaagataactatctaagttacaagccattctcccagagagactaatagaaaccctgtgtacacaccaatgtagacattgaaaacaagagatcatccagtccaaggattctaaacatttttttttttcacctaggagtcctttggcaggctggcttctcagaataatgcttttgaatgcataaaacatcacacataggaatacaaaggaaatcagtatattgaaaatatgcctatcaaaatagtaaatattataaatgtgtgatatagtattatatgtgtttcttcatttaatctattaattaacaacatctatcaggagtctaattttgaagtggtaataagtataaatgatatttcaagatatatgcaacaattgtcatgtgatacaaaaatatttctgatttctattaatgacaaatcccaggttctgctagcatgactatggtttaacgcttgcatttgcagttaaataaaacacatgcttttgttagagattactgaaaataaaaaggagatgtttttctctttcaagttcactgatacgctaaaccccaagttaagaatccctgggttagttcaatccctcattttaaaagtaagggatcttttgtctgagatatgtaaaattaggtcaaataaaattaattcagagaagaccattgatgggtctatgacgttggcctttttcaagtcagcacagttcccttgaggagcttgggtttaaaaacaaacaaaaagacttgaaaagggaggttgtttttatacaatttctgctttctgctcagtgttcctggtccctaagtcctgcttggtgcaaaggcccttgaactaggggaaaggacatgtaagaactaaactcaaattagtatctcaatatgttatcctgccaccgtactaagaacaacaagaaagatgacacaattaatttttgaataaatgtcaacagtaagaagtgtccaaaaatgccctattaaagaacagaatacccagccttgaaatgaactgatactgtacagggatttggggcagctggatctttcaaacctttgtgattgcagctcacagtaaaaaatagacttttcattgagacccatcactcgcgtgcatgtatacacatacatgtgattcaaagtgattcaaacaaaagtttccccaaacaggcttaccttaataagtgatgagacccactgatagtttttgttttattcctttccatttcattcaaaaaatgctagtcagtgactcactattcgtgagcaaggattgggttacaacccatagtttcataaatatcggactggatgaacttcaaggactctcaaattctaagattctatgatgtatgagtgtatcatataaatgaatacagtattgcaggggtggtaaatgtttttaattttattttttatttccagctcttcattttgaaagatttcaaaactacaggaaaataagaatggcaaaataaatgccctatacagttcaccaagattgacatgtattttatcacatttgctttttctctctcactgaacacacacacatacgtatttaagtatatacatactgagacagagtctggttctgtaacccaggctagagtgcagtggcacagtctcggctcactgcaacctccacctccagggttcaagcgattctcctgcctcagcctcccgagtacctgggattacaggcatgcgccaccacgcccagttaatttttgtatttttagtagagacagggttttaccatgttggtcaggctggtctcgaactcctgacctcaagtgatccaccagcctcagcctcacaaagtgctgggattacaggtgggagccaccatgcccggttggtatttaagtctattcttgttatttttgctaaaccatttgaaaataagttgcaacattatgatactgaatcttgaagtgaaatactttagcctgtacttcttgagaacagggataattttctacaaagccacaataccattgtcatatccaagaaatttagcattaatgcaacaatattatctagtatacagctcacattcacattttcccaattgccccaaatgtcctttatagctgtttttctatccaatcaagaactatgcagtacatttgttatttctcattagtatcctttcatcttagttcttcatgacactgagttttctttttaataggtttttgaggatcaggtggtgtttgattaaatacgtaagttcttcagtggtgatttctgagattttggtgcacccatcacccagaagtgtacactgtatgcaatatgtagtcttttatccctcacctacctcccgcttcccccctccgagtccccagagtccattgtatcattcttattcctttgtgtcctcacagcttacctccctcttatgagtgagagcataccatatttggttttccattcctgagttacttcacctagaataacaatctccaattccatccaggttgctgtgaatgccattatttcattcctttttatggctgagtagtattgcattacatatatatatatatatatatatatatatatatatatatatatatatcacatattctttatccactcgttggttcatgggcattttgggctggttccatatttttgcaattgcgaattgtgctgctataaacatgcatgtgtaagtatctttttcgtataatgactttctttcatctgggtagatacccagtagtgggattgctggatcaaatggtagatctacttttagttctttaaggaatctccacactgatttccatagtggttgtactagtttacattcccatcagcagtgcagaagtgtttccttttcaccacatccatgccaaaatctataattttttgatttttgattatggccattcttgcaggagtaaggtggtatctcattgtggttttcatttgcatttccctgattattagagatgttgagcattttttcatatgtttgttggccatttgtatatcttcttttgggaattgtctatcatgtccttagcccactttttgatgaaattgtttggttttttcttgctgatttgtttgagttccctgtagattctggatattagtccattatcagatgtataggttgtaaagattttctcccactctgtgggttgtctatttactctgctgattatttcttttgctgtgcagaagctttttagtttaattaagtctcatctatttatctttgtttttgttgcatttgcttttgggttattggtcatgaagtctttgcctaagccaatgtctagaatgttttttccgatgttatcttctggagtttttatggtttcaggtcttagatttaagtctttgatccatcttgggttgatttttgtataaggtgagagatgagaatccagtttcattcttctacatgtgtcttgccaattatcccagcaccatttgttgaatatggtgtcctttcccaactttatgtttttgtttgctttgtcaaagatcagttggaggccaggcgcagtggctcatgcctgtaatctcagcactttgggaggctgaggcaggggcatcacttgaggtcaggagttcatgaccagcctggccaacatagtaaaaccccgtctctactaaaaaatacaaaaattagccaggtgtggtggcaggtgcctgtaatcccagctacctgggaggctaaggcaggataatagcttgcacccgggaggcagagattgcagtaaactgagattgcaccactgcactccagcctggacagacagagtgagactctgtctcaaaaaaaagatcagttggctgtaagtatttggctttattttggggttctctaatctgttccattggtctatgtgcctatttttgtaccagtaccatgctcttttggtgacaatggctttatagtatagtttgaagtcaagtaacatgatgcctccagatttgttctttttgcttagtcttgctttggctatgcgggctcttttttggttctatatgaattttaggattattttttctagttctgtgaagaatgatcatggtattctgatggggattgcatcaaatttgtagattgcttttggcagtatggtaattttcacaatattgatcctacccatccatgagcatgtgatgtatttccatttgtttgtgtcatctatgatttctttcagtgttttgtagttttccttgtagaggtctttcacctccttggttaggtatattcctaagtattttggggcggggggcagctattgtaaaaagggttgagttcttgatttgattctcagcttggttgctgttggtgtatagcagtgctactgatttgtgtatattacctgcatctctggtatgaaacccacttgatcatggtgggttatctttttgatatgccattggattcggttagctagtattttgttgaagatttttgcatctatgtttatcagagatattggtctgtagttttctttttttgttatgtcctttcctggttttggtattagggcaatattggctcatagaatgatttagggagaattccgtctttctctatcttgaggaatcgtgtccataggattggtacaaattcttctttgaatgtctgataggattcacctgtgaaaccatctggccctggacttttttttgtcggcaatttttttttattaccatttcagtcttgctgcttgttattggtctgttcagaatttcaacttcttcctgatttaatctaggagggttgtatatttccaggaatctatacatctcctctaggttttctagtttgtgcccataaaagtgtccatagtggccttaaatgatcttttatatttctgtggcatcagttgtaatatctcctgttttgtttctaattgagcttacttagatattgtctcttcttttcttggttaatctcgctaatggtctatcaattttgtcttttcaaagaatcagctttttgtttcatttatcttatgtattttgtttgtttccttgtttcaatttcatttagctctgccctgatctttactatttcttttcttctattagatttgagtttggtttgttcttgtttctctagttccttgaggtgtgaccttaaactgtctatttgtgctctttcagactttttgatgtaggcatttaatgccttgaactttcctcttagcactgcttttgctgtaccccagaggttttgataggttatggcactattattgttcagttcaaagaattttttaatttccatcttgatttcattgttgacccaatgatcattcaggagcaggttatttaatttccgtatttgcatggtttttagggttccttttggaattgatttccaattttattctactgtggtctgagaggtatgtgatgtaattctgattttcctaaatttattgagacttgtttgtggcctatcatatggtctatcatggagaatgttccatgtggtgatgaataaaatgtatattctgcagttgttgggtagaatgttctgtaaatatctcttaagtccatttgttctatagtatagtttaagtccattgtttctttgttaactttctgtcttgatgacctgtctagtgctgtcagtggagtactgaactcccccactattattgtgttgctgtctatctcatttcttaggtctactagtaattgttttataaatttgggagctccagtgttaggcacatatatattaggattgtgatattttcctgttggactagtccttttattattatataatgtcccttttgacttttttaactgttgttgctttaaagtttgttttgtctgatataagaatagctactcctgatcacttttggtgtccatttgcatggaatatctttttccacctcttgcactatcttggatgtccagtccagttgagtcttcatctgactccagccccagctgccatcttattatcctggatgagagaccctgcttagctgagcccagtcaactcacagaacagtaagagataataataattcaaaaaacatttattgacataatttcagacttaccaaaaagttgcaagaatagtacaatgaattctcagatatccagagtccccaaatgttaatcctttactatatttgctttattcttctctctcaatctctgcccacctatcatctctctctacccatatctttcattcttatcaaaaatagttaattaacattgatacaatactatagtctgacctatatacttgattaagatttcaccaattgtcccaataatgtcttttatagcaaaacaaaaaacaaaaacttctaaaatatgtgttgccttcagttatcgtgtctctttggtcttctttcatttgaaataattcagtctttgtttgtatttcatgatattgacatttttttgaagcatgcaggccagttattctgtagattgtccttcactttcagtttgtctgatgttcctcgtgactagatttagattatgcattttgggcaggaatcccacagaattgatgcagagtccttcttagtgcctcatatcaggaggcacatgctgtcaattagctccattactgataatgttaactttgatcatttggcttagttggtaactgtcagtaactgtaaagttactgcttttccctttgtaattagtaaatgctttctagagagatactttgtgactccgtaaatgtcttcttactactcaaactgtcactcactggctttagcatccattaatgattcctgccagaatcaattattattacaatggccaccaaatagtgattgtcatatttccattattctttcttcatttataatttggctttctactgtaaggaagatctttcccttctaatttgtttgtttgtttgttcatttaagtgtggactcatggatgctcactttattcaataaattataactcttaatactagcatttgctttcatgctcaaattgtttcagagttgaccggtgggagttcttcaagccggctcctgtggccttttaacatgtctccattatttcttgagtgctcctctactttttaacacaagatgatccaggcttatcttgtatgtcccttgtcccagctcagattccttttagtggagaatgttatgtagaaagcaagaactgggtgctgggtgtgtttatcattactgaggtatcattgcttctacagcctctcaacagacagagctgggaaagagatgtctgtatgtacatatttgcacatacatatatgtgtacacacacatgcatttacatatgtattcattgcatatagatacatatctatattcatttctatatctagctatctatatcgatctacatatatatatatatataatatatatagtcataacttcccaatggtacctccagctccaatctaacacaatgacattcaatctgttcttcccactttccataatggtaactgccttccccaataatgaaaaaactggatcccattatccacaatgtatttacttatttgcttaaccctagaccgtattgaaagtagtttcagaattgtgaatttatgcctatgccaaaaataagctttctgattagagttcattatttgtttaaagttatttgagggcatgtggtccaaattctaaaagctacttggattaatgccccctttcaaatgtgattatgtttttatttgaaaaatgcatcagttcacttgtttctgtttgtattcaattttaaggtcccctgattgttattttaagccactatggcttatcatgcgacaatggataaccctgacaccattgcatcacatcaggaggcatacgatgtcagttattagtgatggaagttggatcatacagataagctcttatctagccagacctctccattataatttataagtaatctgtggggtgccttactctatttttaaagtaattcttactatatgaacttaaaaccaccataactaccacgattcagggaccctaagtcagatttacatttttctttatggaaatgcctgcctcgatgccataggaatacagacagaaggaagagcatctactgatggattacccagtgggtgggggccacagctggcaagaaggtggatatccagctgtgatgaaaacattggattctacttgtagttcaacagcacttaaaacagaatgctacacactgtgtgtaggtttgccaagttgtgatttggatcccaagtcatgagttaggtaggaaggaatgaaggaaggaagggagaaaggaagaaagaaagaaagagagagagaaagaaaggagagaaagagagagaaaggaaaggaaagaaggaagaaaggaaggagagaaagaaagaaagaaagaaagagagaaaggaaagaggaaaggaaagaaaaggaaaggaaagaaggaaggaaggagagaaagaaagagaaaggaaagaaagaaggaaagaaagaaggaaagaaagaaagaaagaaagaaagaaagaaagaaagaaagaaagaaaatctttttattttaggtttttcatgtggagttagaattgggtgcctgctaagaaaaatgtctgtttgtaaagaatgctgcttctctttttaacaataatgcattgattttctagttaggataaacatcctactgtataaaactagtcgagtctatgttgccctcttgattccatgtcttttaatttctgtctttacagatattatttgatcatattcaagcgattgaatcacagtcctctcatattccaaatgtacagatgttcatggctatattcccagtgcctaggatggcacaaagtatggctgagtgggaattcctttttttttgttttttttttgagacagggtctcactctgtagcccaggctggagtgcagtggcgtgatcacagctcactgcagcctcagactcccaggaccaagtgagcctcccacctcagccccctgagtaattgggaccacaggagcacaccaccatgactggctaatttttaatttttcgtagagattaaggtcttgctatgttgcccaggctgatctcaaactcttgagctcaagcaatcctcctgccttggcctcccaaagtgctggaattacaggcgtgagcctccattcctggccaaattcttattctttcattcactcctcacagatttatagcatgcccactcacctgttatgtgccagaattatcctaggcatcaaaccacagtggttaataaaatacagcccctgggtcaagagctcacaggctagatctagagaaaaacaaaaatataaaaattattaaaatctgtggggcctagggagaggaacaggcactgacagaaatatgcacttggtttttgttgttacatttgtaaggcgttctcaatttattcacaatttaggcacatggaagtattattcacaggaaaatgcttaaaaaaaaaaagcacaacatttcagtaagcagttgaaaaaacacagcatagttatggaagagatgggtagaggactccaaattcttgtatatgtatttatcatcatcatcatcgttttttttttttttttgagacggagtctcgctctgttgcccaggctggagtgcagtggcgtgatctctgctcactgcaaccttcgcctcctgggttcacgccattctcctgcctcagcctcccgagtagctgggactacaggcgcccgccaccacgcccggctaattttttgtatttttagtagagacggggtttcaccacgttagccaggatggtctcgatctcctgacctcgtgatcctcccgcctcggcctcccaaagtgctgggattacaggcgtgagccactgcgcccggccctcatcatcatcatttttaaaaagtaatatttgagttagctgaaaagtacctaggattaccactgttgctaaatgttttcagagtaaggcctgggttttatgggatcagaggagaggtgatgagaaaaagccccctgcagtgaacctgagtttaaaaggatgtaatacttgcatggtatttttctcagtacaactgtagttttaaaaatgaagacagccccccaaaaatatttcaataccatgcataatcccatccacaggtaatggtaaacaatctttgtttatatccttcctatttttccagaatataaatatatttaaaagcatataaaaatataaccactctgtattttttcttttgcgatctgcttgtctcacttaacaatattttgtgaatatctttatgcatcatcaaataatcttctaccatatcaaatttaagggcagcattatatggaaagaaagaatgctgaaataacattgctgagagtaagatataaagttacatacagatgcaactattgttgtgttcatttttatctggcagaaatcatttgcatttctactgaaacaaataaaaattgctcataatcttatctgtcttttctgcaagttaatatgcaaatatgtagttttgcataatctaggccctaatcagcagccattagtaagttaaacaaaattacagttctctggaactgtgctttacaatatggtagcctctagccacatgtggctacagagtacttgaaagactagcgcacctgaggaactaaattgttcgttttatttaattttacttaagtttaatttagaaacagtggtgtcaaaataaattaaattatttaatttattcaactttattgaataaattcaactttattatttaggcaggacaatattttactttaaccatggcatcttggcctatgttaagatattgctgcattgggctgggcgcagtggctcacgcctgtaattccagcactttgggaggccgaggcaggcggatcacttgaggtcaggagtttgagaccagcctggccaacatggcgaaaccccatctctactaaaaatacaaaaattagctgggcgtggtggtgggcaattgtaatcccagctactcgggaggctgaggcaggaggattgcttgaacctgggaggcagaggttccagtgagctgagatcacaccactgcactccagcctgggcaacagagcaagactctgtctcaaaaaaaaaaaaaagatattgctgcattgtactgtgtgtgtccagtgcatgagtcattttcagtattacatgtaaacatattattactctagtcagtgtctgattgacattgattcaatttaaatgatgtttttctatgcactgatgtaacactgaaatgtgttcatttgaatattttatacaggcagcactaattacaatgatacttatgtaaatcaaaattggttaactaaattgaagtatttatgccttaaattatgatataattaaactgcttttttttttaattaaaaaaagtgtgaactgttttaaatgtaaaacgaaggcagaattgggtggagaggtagagattattactgctgtgcctggaatagagaaacagaaacaggaagaaggtatgttgcaaatttgaggcaatttgccaaggcaaagcaaaacaaaaaaagctgtttgttgtgtaaaaattgttcaaagataacaaagcggacaatattaagagacattttcagcaaatacagagagaatttgataacaaaagtgaaaaaaatcaataaaagtagttgtcggaattcaaaattgaatgtccaataaaaattgtttaaaaagtgataacaggctctgagcttggaactttggctagctttatactggcttggattcttgcacaaaaaaggaaaacagttttagatggcaatagtaaaagaaattatttcagttatggaaattttgtttaaaagttgtaacgaaaagactttaaaatatattttacaaaaaatgaaagctcttcaattaaaccacaaaataattgcctgtagaatacaagaccagtatccaagattaattaatttaaaattcgaaaaattgcaacgattttagctttagatgattcatgtgatctacgacactgcccaattaatactttgggtatgttttgactcaaaggactcccatatttacaaagaaatgccaattcatacctttaaaaccttatagcaaaaattttttaaatcttttacatctctcaaggaagaacttcagttagatatgaaaaaaaatcacaatgaatactgctcagccatgttaggtcaaaattccagatgtattggaattttaaaataggagtctgatgttttcctggtgacttcatatcactgtatgacacataccgaaaatatttgggctcccttctctgaaacagactctgtgaaaggagtcatgaatgctgttgttaacatttttcagcatatacgtgcaaatgctgtgtgtgactcatcaccagtttcaagaactgttgaaagaaattaaagacaatgaatttactcttgtgttcattgccagtgctcattggttaagccatagagttttaccaagctgttaactccaattcaaattttcttgaaacaaaaggagtgcttgccaaatatacagcaatcaaagaaaaaaaatagcaatgtgatttatgtgttttctcacggatatcacactgcataggaacaagataaatttaaaactccaagaaaaggaaaagcttatttgtgacttagctagacagttaaaggattaatgttgaaattgaacttttttgtgatacaagtcgataataatgattttatacctttttctaacatgaatcaaatatgcataagactttattaatagacagttatgtaaattggctgcaaaaactatagaaaattttaaagaatgctttgtttatattgataaacttagaactgcttctcaaatcatgcaatacccctttgaattcaatgttaataatatggagttgacacaaattagtgaatttacttaacttggacagacatgattttgaaactgacatcctttctcttcaaagtaaaatcacttcttctaaaaaaataagctagttttgtcaatgaggatgcaaatattaaaggaaaataatttttgctactcaattcagttacaggaaaacttttaggtatgttaaaacaccttggatatgtgaatccacctttcttccaaatgcaaattttatgaaacctaaatacagaagaagcacttcccgtgaaaatctagcatctgaagatgtgctgtgagtgtaaaatactcattgtatttcaaaggcttaggatgaaaaagacaatctaaaatatctcattaacaatgtttttacatattgaaagaataatattttaaatacattaggtaaaatcttatgcattattaacagcaatctatctggtttctttttttctttttctttttctttttttttttttttttgagatggagtctcactctgtcacccaggctggagtgcagtggcacgatctcaactcactgcaacctccacctcccgggttcaaccaattctcctgcctcagcctcttgagtagctgggattacaagcgtgcaccatcgcacccagctaatttttgtgtttttagtagagacggggtttcaccgtgttggcagggctggtctcaaactcctgacctcaagtgatccacctgcctcagactctcaaagtgctgggattacaggtgtgaaccaccgcgcctggccttatctggcttctttctacctattttttaatgtggctactagtaaacttaaaattgtatctgtggctcaattggacagcactgctctgcattaggcagcgtagatttactttttaaataatactccagcgggacacagaaagaccagagagtaatctttttattacttaatatgtaatcttatttctgaattttgggtaacttttcttaacattattagctcatgaaagaccatgctggccgggcacggtggctcacgcctgtaatcccagcactttgggaggccgaggcaggcggatcacgaggtcaggagtttgagaccagcctggccaaaatggtgaaaccccatctctgctaaaaatacaaaaaattagccgggcatggtggcaggcacctgtaatcccagctactcgggaggctgaggcaggagaatcgcttgaacccaggaggcgtaggttgcagtgagccgagactgtgccacttgcactccagcctgggcaacagagtgagactccgtctcaaaaaaaagagaaagaccatgctatgtctaagacttacagcaacttagcaagtttagagtcctgtgtctttggaggaataataggagttgagtgacaaaaggcaggctaaagctagatcatgagatgtctttaagccacatgtagcatttgatctttattctgtaggcaactggcagccactgaagagttttaccgagggagttgttgcattattagatttgtattctggaaaagtaacagttgaagaaagcaaggcatgaattgcaaggagccaattattattgtacaggatagaaagaataaaggcccaaatttagataattagaaagagggcatgggggaaatgatgagatgaatttaaggaagatttggtgtgggaaaggaagatttggtgatagggtgtgggaaatgaaggaaaggaatcaagaatgagtccaaagtgtctgatgtggtcagctccgtgggctgtggtacagagtctgttcttattcgctatttatgagcgtgtaaatgtctcaagtttgagattgcgcaagaaagaccaagcaggggaagaaggtaaagagttcaatttggccatttgactttgaaattgtagagggtaaagaggaacaataaataggtccaaagctcaggggaaggagtaggagccagggatggagatttgggaatctgcatacaggtggctagaactgtaggcatagatgagatcacctggagaaagaggttttccaccttgccgacaccttagaatcacttggaggcatttaaaaataacccaatgcctgggacataccacagacaaatcagggatgagacccaagcatgacaatcttttaaagctttccagttgattctaatatgcagccagatttgagaaccattggtacagggaaaagagagaagacgtgccaaggatggaagctgtgagaagctcaacatttacagaaaaaacatggagacaggaagaagttggtgaaggcaccatcaaattgaagaagcagggggaaccagaaggtagtgatgtcatggaagccacaggaagaggaggtttcaacaatctattataaaaacaaagatcaagtaatgaaagaactgagaaaaggtcaacagggattgctgaacgggatgaaagcccaattgcattgaagaacacacacacacacacacacacacacacacacacacacacacacagagtatatatgagtcagcaccagtgtgaggttttccattatcctgaacaacaattgagaaggacaggagaaggcaaaaggctggattggtccagggttgggagtttgcagtgtcaaaggatgagggattgaagagttgaagtcacatcagacatgatgtgactgatgtgaccaaccatggggagagaactaaaatgagaaggtgagggatcaagtgaggaggaaatgaggtggtcaggggactgaaggtcctgatgtggtcacagaacgggtatagcacacatattgtgagtggcctcattccctttacaccagctgcctcctcctcctaactcctccacttcctccctcccaccctcgatctcctcacccacaagtgcatccagaatgattggtgctgaggaggtcaaagaattgaaatagggcactggctgcctcatgcacagaaaagccaaaactctacccaggatgaggcaggcattgaggtaacggctgcatcaaagtcatcaatgaaggtgggagggtgacctagaggcctgctagagtggctgaatggggcatgaatctcccaagggaggaatgtgttagttttttgttgttattttttaaactgagtctgtgaacaatgggctgaaagtataaaaaaggcaaccttccttttttctcctcaaccctgcactttaaaatgtagaatgtttctcttaagtcaaacttgcccattaacaaaagatttaaacatgccttagactctgctgtgtcatgtacatttcaggagcattgctttttttttctttttcttttgtaatattcttttatcttctatacatctattgttttttgataacctttaattttgatatagttttaaaggcgtgcacaaaatgttgcaaaaaaagtacaaaaaattttgtatatatacctttacccagctttgacaattgttgacattttgctccatttgcattatcagtctctttctctctctttttatttgtacatgcatatttttccctcaaaccatgtgaaagtaaattggaaacatattgcccctttatacaaaatgcttcggtgtgtaattcctaagaacagggacattctcttacataaccacagtacactgatcaaagtcaagaaatttaacattgacacaatgctcttgtctaatccacagtccttcctctgctttggtcaactgtcccaataatggcttttatggcttttatggttttttttttttctggtctaggacattgtgatttagttgtcacatctctataatctcttttcatctagaacagttccttaccctttctttgtatttttttaccttgacattttgtgaagagcatagactattaattttgtggaagttcccttagtttgaatttgtctgatattttgccatgattagattcaggttatgcatttttggcaagaagattacagaaaggatgttgagttctcagtgcatcacagcagaaggcacatggtgtctgtttggcccaactggtgatcatcacaccattgctttgtcatagcaaaggaaagttcttttagctttattttttcaatttggaaggcatcttgcattgcagcaaaattttcttttttacacaagcataactagaggcttttaaattatttttgattaattgcaaataaccaaagagcaataacctaggttgcttttttttttttgaagaagaagcaagtttaaaaaacttgtggagttttactgtcaacaagtatacttacactgaaacaaaatctattactttcagagaaaaatgagaaaactatacatttgtaaataagcttgataaaatgcaatttaagattattaaaggacaaagttccagacacaatgtacatatatatgtgtgtgtgtgtgtatatatatatatatatatatatatatgtcttgaaacagggtctcactctgtcactcaggctggagtgcagtcacacaatcatggctcactggagcctcctgggctcaagcagtcctcccacttcaacctcccaagtagctgggactacaggcccatgccaccacgcctggctactttttgtattttttgtagatgcccggtttttctatgttacccaggctggtctcaaactcaagggctcaagcagtccgtccaccttagcctcccaaagtgctgggcgtgagccaccgtgcctggccaaatgaacatatttttaaaatactgatatgaatatatccttaaagtacaaggcctttataactaacattgtaatatgccaggcaatacaatataaccagaagagacatatggcttagtggagaggagtgaatcctagcagtgatcgctacgtaatgattttaggcagatactcaagagtctgacagagggcagtcatgggactggttgtgccacggggaagaagttgaaaatggagtttcaaaagatttgaaaatcagagttgggtcaacacgcataaatttacttgctttgaagacgttgaaatgggatccaggaacaggaaaaaagaatatttattgttttgcctttgcatgccaaaatgtaatctctctttttcttctagactttccttaaaataacagttgtctgcatgtagaatgagtgtgttttaaaagagccattcagggcttttttcgatgctcatttcctgtactgagtagcaacatgatgacagactagaaattctactgactgagtcagactgaccctgaagccaagcctcactctgccacagactggcatgaggccttgagcaagtcacttgacctcggtgtctcaatactgtatttaaatgagagaatgaaccttgcggggtttggaaggttagaaataacacatataaataactcatagtactttacaaatgccgtggtctatcctaggtattcaataacggaatttagacgtgaggacaatttcatgaaaagtttagtttaatgaaaagagctctggtctgggaaccaggacaccagggttctggtccctttctagtttatttaactagtaagctcctaaccttggcctcaaacgttttggactgtagtcccattaagcaaggagtgttggcgagagagaaacaggtcaagttcttggggagctggcagggagctaacatggtaccattaatacaagttgggctgtttttcactggcaggctgaacactgtgctgtggaaacacggaggtgagcgaatgagtgcgcagctctgcctgggccagggggcgccacttgaactgggcctgcttgaatgctcctgtatggatttttccactggagaaaggagggtgttccaggtacccaagatttagcaggtgaagagacagggtgctgccaccgtgcagaatggtgcttcacatcaaatgccactgcaagcagcttctgagactgcccctgactattaagttgtatcaaatacatgttaagtaggccaggtgcggtggctcatgcctgtaatcccaagcactttgggaggctgaggtgggtggatcacttgaggtcaggagttcaagaccagcctggccaacatggtgaaaacccatctctacctaaaatacaaaaattagccaggcatggtggtgtgcatctgtaatcccaactactctggggctgaggccagagaatcgcttgaactcgggaggcggaggttgcagtgagccaagatcatgccactgcactctagcctgggtgacagaggagactctgtctcaagaaacaaacaaacaaaaaatagaaataaagatacgtaaaaagtaaggagtcctgaaggagtgtgacacctgcataacaaaatcttcaatggagctgctatttaatgaatactagtcatgtgtcagacactgccctcagtgtttgccaggtatctattcatttaattctcacaataacttgatgaggtgtttattacctcgatgaggtaattattagctccattttagagagagggaaggaagcacagagaggctgatgaacctgtacactgtcacacagctagtaataggtaggggtaggaatttcaccccagaagttgtttggtggaattagggaatagcttcagagagcagggagagaggacaccctcctccaatcgcacacacattgatggggacgggggtgcctactggtgggaggtaagcagactcatacacctgaggttcgtggagtcctaagaaaagtggagacactttgggacaactaggcagggcgatcagagtcagcaaggtgagggggtaaacagcctgactcctgagccacccgcttgggttcaagtcctgggtctccaactttctagctacctaacctctttgtgcctcagttgacccatatgttaaatgaggataatttcacctacctcttagaactattgtaagcatgaaataattttgttttggaagctgaagaaggtatcaaagcaggtaagtgttagaggagctggcctcaccttccttgtggcccaagaaagatatttaccccagggcattctataggcttcactggtgagatgtctttcctcttaggccatcaaatatttggaatttttttacttgcccagtcatgatggctcacatctgtaatcccagcatcgttgggaggccaaggtgggaagatctcaagcctaggagttccagaccagcctgggcaagatagtgagacttcgtctctacagaaaataaacaaaattagcctggcatggtggtgcgtgcttgtagtgccagctacttgggaggctgaggtgggaggatcaattgaactcaggagtttgaggctgcagtgagccaagatcgcaccactgcactccagcctgggtgacagagcaagatcctgtctcaagaaaaaaaaaaaaaaaaaaaaaaagaattttttgacttaaactttgtggtgaaatgagagaagacctgaacttaggggtagtggtggtcttggggccaagacagagaaaaacgtttctttcagtctccacaggcacttgtaacacttgtaacacttgtaaagtgctaggcctctgggttataggattatccccacctgtccacacatctctgggaaaaccacaaccaggtagctggtttcccagcagccttcatttttgctttttttttggccaacacctcacttcaattccctcccattaggcatttacctgaaatttttgggtgatgaagtctgcttattaaaaattactatacagctttacctttcaaagttggtgtgactataagctgcttcttttttttttaattgaattaaaatgaaataacatcgaattagccacttgaaagtgaacaattcagcggcatttagcacattcacaacgttgtgcaaccatcacatctagttccgagacattatcgtcaccccaaaaggaaacccttacctatacagcagtcacttcccctgtcccccccgcttcctgtctctatggatttacctattctggacattcatataaatggaatcatacaacatatggttttttgtgtctggcttctttaccttggcatgatgtttctgaggttcatccatgttgtagtatacatcaggacttcattcttttcatggctagataatattccattgtatggctctactacattttgtttatccattcatctattgatggacatttggattgtttccacctttgagtattgtgaatgacggaataatgttgctataaacattcgtgtttttgtttgaacacctgttttcaattcttttgtgtatatacccaagagtggagttgctagatcatacagttactctgtttcacctttcaataaaccgccaaactattgtccacagcagctgcaccgttttacattcccgccagcaatgtacgagggatccaatttctccgcatccttaccaacacttattttctggcttttaaaatgtgtttctttatttactcacatatagccatccttgtggacgtggagtgagatctattgtgatacaaaccgctttttgatttgacagtggttctcttggctttacactggaatctcctgggtatttatttatttatttatttatttatttatttacaatcccaatgcccaggctgtacctggggccaatttcattagacactagggctagccccaggcagtggcagtatgtttaaagctcccaaggtgattccagtgtgcagctgaaattgagaatcgctgtaaagatcctagccccctattgcttacatactttttttcttttttttttttttttgagatggagtctcactctgtcacccaggctggggtgcagtggcccgatcttggctcactgcaacctgtgtctcccggttcaagcgatcctcccatttcagcgtcctgagtagctgggattactggtgcctgccaccacgcctggctaatttttgtgtttttagtagagatgggatttcaccatgttggtcaggctggtcttgaactcctgacctcagatgatctgcccgccttggcctcccaaaatgctgggattacaggcgtgagccaccacgcctggccttacatactctttttaatcaaaatcttaaatagtgttaaaatagctgggtgagtcccacattcatctgaaaaaatggcggggagtgatccagatctttgtcagccactctaaccctaatagctaatgccaagtttttaagaggggaagtgatttcaccacagcggcacacaggggccagggaggcagaatgtctccaagggtcccaaatgaactggtgaaaaaaaaattatgttaaaaaaaaaaaagaaacaaaaggcttgatgaccagggcagctattaaggactgccaacccccatcagctccctcacctgccctgcaatgaaagtttgggacagcagcatgatgggtggccttacagtgcaggccaatagcctatggatatttccaattagcacctcagctacccagccactgccaccaccaccaccaccaccacctcctcctttttaacagagggctcttttctgcttttgacttccttcttcccagtacacacttgctcactgtgtaggacaatgtggctctttctctgaatttttagaaactctgttgctgatgtccagcttggcctgtctgctcagaagcaagtgggcccatttgaaagggaggtagggataggactaatacttagtaccagcattttgctaagtgggtcaccaaagctctcaccctaagcctggacttcatcttgttgtctatattgtcactgcactgtagtcacacactcccaggaacacacctagagttgaacaagcagttttcttctccttgcaggcggggaaaacacataccatgggaataggggcagtgatggggcaggggctctcaataagagggtgcgagaaaggatgacttagaggatttgcacctgggtatgttagaggcacctgacagcaataacctgtcaggtgagaatgaccctgtatgtcaagtgcacctgaatgtgtgtttggagttcccagcatggccaaccagagagtcattccttatctatggggaacatctgaacctctggcctggccaaagcagtgtgggtcctgaagcggattgaggcccttagtttagggtaaatgaaggttgccaggttgttagggggagggtgttctcctgttgagcccactgccactggatcgtccccgtatgtaagttaccaataaactctatgtctttgagtctcttctttggccgcttgaacctggtgccttccctactgaagttaataggcatctggcatgacactgtgtcaggtggttttggggagcgtttagggaagccaggtgttgctctggattgggagctggtgcagggggctggggtggggggaattctgtgattggatggtttaataaatgtcctctagaagcagagaaaattagagccaggctacagctgtggttggtaaagaagtagcagtcacccatattagccaggactggggggagaggtggtgtttggtcatatttgtggtttggacaaggcttatgttttctctatattcagacatgattacagagtggtcttgtttgtgttttgtcccaccctggtcatagagtggccttgcctgatgttggtgttttcgggagttgtttctgttcaacaggacatccaggcacagctgtgagtgcctggccagctccgtgaaggcaggactgctttactctttctcagtcttccttttcgggcaagagtagtccagcggcaggctgcaggacatgaatccacgatatccacattttcaccattggcaagactgtttcaagaatgcagtctctagtcggactagggtaaatctagtctctgctgagtcttttgttgcaggacgagttgctgaagtgtctgataacagctgtgcagtatttaagactctgcacaggatccactggtcgactataacacaattaccacaaacaaaatgattattagtcctgaaacaggcctggaagccaagggcctagattataaaactcaggtaatgagaacatgttcctgaatccaaataggtactcacggcccaattggaggtgtttaaaagaggcctcgagcaggattatgttactggtaagtaggacgtgcattgggaacatccttgcaataactcctaatgttatcccaacaatgtaggttccatattgaggccaatttaactctgatgctgtgctaacatcatgaagcatttgttgtggttttttatttttcgttttttgagactgtctcgctctgttgcccagtctggagtgcagtggcatgatcgcggctcactgcaacctccacttcctaggttcaagtgattctcatagctcagcctcccgagtagttgggattacaggtgtgcaccaccaagcccagctaatttttgtattttaggtagagacgggattttgccatgttgaccaggctggtctccaactcctggcctcaagcaatccgcctacctcggcctcccgaagtgttgggattacaggcatgagctgccatgcccagccaatgaaacatttgttaaactccacttttgctatggctgtctgataagttaagcaaaagcatctcaggtttttcatctctgctttgtaccttgcaggaaacaaggcgaggcacaagtgctggggatgagatttcaagcccgagcccgagggccacctgtgctgccagacacaagctgcagagcataaccagctacgcagtttgcaggccaagggcaaaataaaaacacggggccccttgttcgagagttaagaatttcaagatggcaacagcagagaattaaaccaagtgcagggcccttttgatgtgaggcccacactggtgctgagtggggaaaggcacacctgaggcccatggagccctactgctcctgcaacatgcaggacaaagacaactctattgtcagtgacctgactccaggggaatggcaagaagtgaagaacatcccaggaagaaagaggagctgcagactgacatagctaactgaaggatgagaattgcaatagctaacaaaattgagaatctaggacacagagaagaatggtaagacatgcagaataacaaacaggtggccatgggtagacaaaaattaatgcaggtactagaaaaagattcagttcttaacagagaaaggtctgttcaacagacccttgttgaacacttgtgaagacactgcccagtttttgtagaaaggtgaagaactcagcaaaacagccgttgcctgggggaagaggtgagtttaatatccaggttcttcgttgcttttgtggaggtacatgagttcatggatttaaattttgtctaaccattacagcaattcctgtggccgtgagaggcacaaaagcctgacacgatgatggaggcatttgcccagggatattgtcagtgcagtaaagaataattttagttcagacgctcatgctgtctcccctttgccatcattttgttgaacagcagccataaccccagtgtcaaaaataagccccccgcaaaggctattgccattaatagaggcgccagtgatggaggagtcctgctagacaagcaactccggagtctgcagtttcctaattcaatattaacaacaatgctgtcctcttactggcttctccctcattttattttgcgtgaaactgtggataacgtaaatgcccaagcgctttctattcagtcctcaaatgcaaagcagacccttgctaataatggtaataatccgaatgggtttaactgcagcattgtaagaaaaggcaggcagtactcttagactacaggggtggatctcatcatttgattttcccgactccgccaggaaataagaggggccttggcttggggagaggtgtgtggggaggcgtaaggggtgggccccccggaaatcctgctgcgctgtttaaacctaaggtgacctaacggatggcgggagcggccgcgcgagccttggagcagggcgcggccattggtgacgcacgccggggagcacggcgcccacgtttccaccattagcgaggcctcacacccggcgctccaagttcggggctggaggcgtcccggcttcctccctcccggagcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaaggtgagggcgcccgccgccacctgcgtggccatccccgccgctcccgccgcctggcgggctggggcgggggtcgggcgtggcgtgcgccgcgggccgaacaatgcgggcggcccgcgcggcgccgcactctcccggactgccacgcacagcgcgctgcggggccgcgtgcaccggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcgggtaaatttccctcttgggggcgggggtttcccctcgtagggagctggggctggggaaaggtctgcggacgcgcagcgcttgcagaattctcagccgactgcgtaggagacggatcccccggaaaggaactgggggacgggaaaaggaaacgattattattattgggggtggggaggcatgaggtctgggcgcgggaatcgtttacaccccgaatcggggagctatcaaaagacagccggccgggcgcggtggctcacgcctgtaatcctagcactttgggaggccgaggcgggcggatcacgaggtcaggagttcgagaccagcctagccaacatggtgaaaccccgtctcttctaaaaatacaaaaattagccgggcgtggtggcacgcgcctgtaatcccagctactcgggaggctgaggcaggacaatcgcttgaacctgggaggcggaggttgcagtgagccaagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttggagtgcagtggtgcgatctcggctcactgcaacttccatctcctgggttcaaacaattcttgtgtctcagcctaccaagtagccgggattacagactcgagccaccacgcccagctaattttttttgttgttgtttaaagtagagacagggtttcaccacgttggccaggctggtctcaaactcctggcctcaagcgatccgcctgcctcagcctcccaaagggctgggattacaggcatgagccaccgtgccggtgtgtccatgggttttcttttatgctttaaggagggtgatctcagcatggagcccaaagactctggcacttccctttgtccttaaacctccttggccaaatttagatttagtctcttgaagtgctggttcacaataggatgtttttgttgttttgttaaagtgggaaaagagcgaatgaagaaaaagtgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtaacctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtggcagatactgttaggtctgtcatttggaccattgctatatgatttgtgcagggacacaaggagatttgtgtcgctcaaattcacaaattctataaccttgtttaataatttaagaacagaaggctacttgggaattacgggcttagcggagaaggtttggggcagggggttcttttgtacccttgaccctcatcagggaagcctgtgcacctcttctcagagtaagaattttagatgcgtgaaataacccaatcttcaaaatacaaaacccccaccgtgtggtatggtaacatgtgctttgcttcccgtccccccccccaccccctacagtctcgctctgtcgcccagagctggagtgcaatggcacgatctcagtgtaacctctgcctcccaggttcaagctattctcctgtctcagcctccagagtagctgggattacaggcacgcggcaccacacccggctaatttttgtatttttggtagagatggggtttcgccatgttggccaggctggtctcgaactcctgacctcatgatccacccgcattggcctctcaaagtgctgggattacaggtgtgagccaccgcgcccagctcatgtgcttctttattaacacatcaaataacaagatgtggcagcaaggctagtaagtttcataagtagagctgagcaaaattgatatttaacaaattgttaggcaaggagaaaaacctgattttttgtgacaatgaccaggtgtagttgacagtgtgtgattttttggcctccaagcataactgaagaaagtgctaaatttctattagtgaaaataagtctgtgtgtttttttccattcaagttcacaggccccctgaattgtatccattggccccttgggcatccatggaccccaggttgagacccccaggctggggagggggaggactgagacagcccgttccttttagggggtgtaggtttccacccaaggccaatgctggaggcacatgtccctagttattcttcaaaaacaaaagcggctctttgaactatttgaaaacataaaagttgtacttagtaattgccacaggggctaagtgccctgagtgctttgtgcattaattttaggtaaatcctcaaaataaccctaggtaggtcttgttatccccattttaaagacaaataaataggcctaatcttgaggttttttactttttgagtggcagagctggaattcaaagccatgtttgtttgattggaaggctggttctgcttccacgattctgaagcctcttagtttaaggcggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgctgattaaagtatgagaactcctctagtaggttccttatttaaaacaacaacaacaaaaacttgtctgaaacctttggcacacctacctcactcagcccaaccagtcagcctagtcagtctcattaagtcctgtggcttctgcctgccaatgttctcaaatttgttgctcatcacctgttccttactttagtttcctggctacagtctccccatttgtctccgtttggggatgggcccgatcattaggaactcaacaggatccctgtcccttttcccatttaaaaactcttccgtgggtccctattaccccatggatgaagtctaaactctgtatcaacacatacaaggtcaatttctacccggtttttcctcttcccccagtatattccttgtgcttcccggtagccaggaagcacctggactcaggatttgacagctttggagaagacttttttgtgtgctttacataggaattctcatgcgttaattgtgtttgaaaatattttatgggctgcttccgggagatcccttgttggcattgccttcctttggcatgcgcttttgctttgtgattttttttttaaatgctcttttcccaactctgcaaaagattcttaattgcacaggttatgctctatatgactccaggctgaataacctcatgttgccgggaattagttttgtgggcttgccattaaaaaattgagtaaaccacaatgattctttttagattgtagtttccaagttataccgatttccttaaacctatggaggtagcatatggtaagattttagtttctacttcatatctgtaatcctcatctagttctcattgggtagttcagtatttaaaatgctttggaagggatgacagctgtttaagaaattgactccataatcaaggcgctaggagtgacccccatcctggctaacaagagaggggtactttttcaagtaatctgaagccccgcatgagacattctaatttaataaccagtagtcagtcaatgtgtctttttttttttttttttaagaaagtcacttttgcatttgcagtggaggagttaccaattgggaatcttctcatccccttagtatgtaatttactccgttttgtttgaattggtagtttcaggccttagctaccttctcaggagataaagattaaaatgctgtgttctctaatagctttaaaaagttagagcttttgattttggatttcatacccagaagattggagattatgggctttataattgcgatcaccatggttatgctaacctttcacagataaggattagttataaagttactagcatctgtttaaaaacgtcaataaagttcttagtttagtttttggagtctgcatattccaggtgttttaattcactatttcactgcagttgtaacctaagcctgctggtgtgcactgtggctccgaccaccatttcatggtatagactcagttcttttgaaaagtcagaaaacctcctcaattgaatctgcgaaccacgtatgtaaaccatgcacaaatgctctttaaaacccttacagctaggcacttttccagaccccaggaaaaacaaccctgcggccctgaggtgtggtgggcctgggtttcattaaattgacactgtcatctgtgttccggaaggagccaccgagctagctagtggtgatactggtgataaatgtgtttacgtgctaagccacagattcaaaaggagctggtaagagccagtagcatgttctagattcctgaactgacttgactctgggtagttttacacacaccttaatttttccctctccatgaaggtgctaatgatactaaaatcccacacactgtgtcgttgggtggaatgtccaataaaatgtttggaagagtatcaaatgatacataaaatacctaacactaattgcaatacttagggcagagtactttgaaattgtgccagtggataaagatgctcagttataaagaggtgtgaatttaacttacttgaagggtaacgaaagctctgctggcaagagaagaggcagaaaataatgggttgccctgtgttttgaaggttggtctactttatttaaagggcttcctccctaagtgattaaagcagaattttaaaaggacactttgatttaagatatcaattacttgtgttgcatgactccattttttttcataaatgaaaatttctccagtgagaatcctgagcaattcctagaacactgctgtatttaattctgaattctcccttctagaaggactgtagatcacagtgttcaaacaagacttatgtgcctgtgggcattccaaattcctttgctggccttacagtgcagaggtgaatatagaactgttcctcaatcctttttcttagagtacaggttgagcatccctaatccgaaatgctccaaaatctgaaactttgagcaccgacataacacaaaaaaatgctgattcgggatttccagattagggactttgagtcagtgagtgtgatgcagatattccaaagtggaaaaaaaaaaaaatccaaaacactttcggtcccaagcattttggataaaggatattcaacgtgtattttcagggccagtgccttggatcatgctttggaaaacagtagtggcatagttttttgtttttgtttttcaaagatggggtcttgctgtgttgctcagactgatttcgagctcctggactcaagggatcctccagcctgagactcctgagtcactaatgttactggtgcacactgcagtacctggctgaagttttataaatggcttaacactgaatcttttaactgtataaggcagtagctaagtggcccagttgcatgtggaattttgaggaagatggtcatgggtttctcagtccaagtgtttgttcctacgtgggggtttgtctaatttggagctggaggcttgatgttgagaagagagaggaaagagcttactattaactccctttggtatgagatgcaagaatatgacaggactttttttttttttttttttttaatttgagttctgggatgcagtacagaacgtgcaggtttgttacataggtatacatgtgccatcgtggtctgctatacctatcaacctgtcatctaggttttagaccctgcatgcatttgtcctaatgctctccctccccttgccccccaccccctgacaggcccaggtgtatgatgttcccttccctgtgttcatgtgttctcattgttgggctcccacttatgagtgagaacatgtggtgtttggttttctgttcctgtgttagtttgcctagaatgatggcttccagcatcatccatgtccctgcaaaggacaggaactcattcttttttatggttgcatagtattccatggtgtatatgtgccacattttctttatccagtctatcatagatgggcatttgggttggttccaagtctttgttattgtaaatagtgcttagtaaacatacgtatgcatgtgtctttatagtagaatgatttataatcttttgggtatatacccagtaatgggattgctgggtcagatggtttttccggttctagatccttgaggaatcaccacactgtcttccacaatagttgaactaatttacattcccaccaacagtgtaaaagcattcctatttctccacacctctccagcatttgttgtttcctgactttttaataaggaccattctaactggcatgacatggtatctcattgtggttttgatttacatttctctaatgaccagtgatgatgagcttttttcccatatgtttgttggctgcataaatgtcttcttttcagaagtgtctgttcatatccttcacccactttttgatgaggttatgtttttcttataaatttagttctttgtggattctggatattagagctttgtcagatgggtagattgcaaaaatgttctcccattctgtaggttgcctgttcactctgatgatagtttctttagctgtgcagaagctctttagttgaattaaatcccatttgtcaattttggcttttgttgcagttgcttttggtgtttttttgtcatgaagtctttgcccatgcctatgtcctgaatggtattgcctaggttttcttctagggtttttatggtttggggttttacatttaagtctttaatccatcttgagttaattttttgtataaggtgtaaggaaggggtccagtttctgttttctgcatatggctagccagttttcccagcaccgtttattaaatagggaatcctttccccattgcttgtttttgtcaggtttaggggctttttttttttttaagcattttgtgactgctaaatttttagtggagttcctgtaatttatttctttgaacaaagggtctggctttgcttcagaaggctgcaggaactgttcaagtagtggtttgtgcatttgtctttttactacatctgctcattttacactatggggttagggaaatgtaaagaaagaggggatacaactgtgatactgtcacaagtagataaccactttgatgtgtggtacaaatggcttgcttattcttgttgcatatataacaatgttgtacgtaaaaacactggattttggagcccagctgttggggtttgaatcctggttccactacttactagtgtgtgtgaccttgggcaggttgttaatctatgtgccttactgtgctggctatactttggttacccttgaatagcagctgtgagaacagacatccttgccttgtttttggaccttatggggagagcagtcttttaccattttgagtattatgctaactgtaggttttttgtagataccctttatcaagttgagaaagctctcctctattcccatttttgtgtgtttatcttgaatgagtgttggattttgtcaggttcttttttgcataaattaatataaaatgtgggtttttttctttaacctattatggtggatcacgttgtttgtttgtttgtttttttttttttttgaatgttgaactagccttgtatacctggaataaatctcacttggtcatggcatatttttctatattgctgaatcctatttgctaatgattttgtcaaggatttttgtgtctatactcatgagggatattggtccatagatttcttttttggactgtcttggtctggttttggtattagcataatactggcttcataaaatagggaggccttcccttctggaagagattgtgtagaattggtgttaattctttaaatgtttggtagaactctccagtgaaaccatctttgtctcaagatctcttttctggagtgttttttttcttgagagacggtcttgctgtgtcacccaggctgaaatgcagtggtgtaatctcaactcactgcagccttgacctccagggctcaggcaattttcctgcctcacccccctcccctcccgccccgcaaggtagttgggactacaacaggtacgcaccatcatcactggctaattttcgtatttttttttagagacagggcttcctcatgttgcccaggctggtctcaagctcctgacctcaagcagttgacgcaccttggcctcccaaagtactgggattacagacatgagccaccatgcctggcctctttctggaatttttaagctataaattcagtttccttaacagttataggactcttcatgttatttcatattcggtgagttgtggtagtgtagccggattggtaaggcatcagagagaccaatggggttcaggaggatatttattatttaggtgcaccggcccagtcggattaacattcaaaggactgagccgtgaacaaagagttaagttaccttttaagcatttcgtgggggcagggggagatctgtgcaggggggagcatattacagaagcaagaaacaaagacagttattcagttaattgagacatgcattacatcatttcttactttttaaggaaaaacatgttttacgacttgagtttgtctagtgaccttgcagctgcacagctagagaaacagggtcttcacaatgcctgggaaaggaggagagataaggctcactagccacagaaaaacaagcagttaatttttaaaggactccagctctttctctttctcagcgggaactgggttttcttgcatacaactgagtttctgcttacacattctttaatttcttttaattcctatttcattagtttgtgtttttagaggaattgccccatttcattcttaagttgccacatttatgtgtgtagagttgtagtattcccttatcctgttggtgcttgcagagtatccacagtgatatctcctgttattcctaatattggcaatctggttttttttctttgtaagtcttgctagagtttatcttaataatcttttcaaagaaatagctctttgcttaatttttttctcctctagtttttatcaattttattgatttttttttttttttgctgttatccttctctttttgctttggacttttctctttttctaggttcttgaagtactagtgtggattaggaatttgagattttaaagtggaattcggtactcttaagtattctcattctctagtatgcagtttctgttgatactagttgataatgttcgacgtattccttaaaaagcaagagtcttagttatgttggttgttagctgttcttttttcaacacaataaattgctaacttgaatataggaaatattcctcagattattctagtttcaaatgctaagaatgttctgaagtccttggaccagattctgctcatctggcctgtttttgtgtgaccctccagctaagaatgatctttacatcttaaaagggttgtaaagcacacacaccaaagaatatgtgacagaaacctgatttagccagaatgctttaccacgtggccctttacagaaaaagcttgcccgttcctgcctttagaccatctaggtgcaatgattttgattgcccgtttcagagccatctggaaaaatttggaagtacagatttccaagcccttcacatggctgccttctcgtctggaatccatcatagtgcacggccatctctgtgtttgagtagttttgacttgtgtcctctgtctttcatctttattctccagtggcacttacttgtccagcacctcctaggtgctgagtaatctccttgggggcccagttgaatgtggtcttggctaatatactctggtaaagccacaggaagggaaggcagagggacctcctcagcgacatgtgtatcaagtacggtctaatataaatgtgatatttttttttgacatcacacaattcccaaagtccagactgttttatctttggaaatgctatttcattgttgatacacagcctggcatagatgctcagacagaacccttgaagtattgtttttttttgagacagtcttgctctgttgcccaggatgaagtgcagtggcgtgatcttggctcacggcaacccctgccttctgggttcaagggattcccttgccccagcctcccgagtagctggtattacaggcacccactaccacagcgggctaatttttatattttagcagagacggagtttcaccatgtttgtcaggctggtcttgaactcctgacctcaaatgatccgaccgccttggcctcctaaagtgctgtgactacaggcgtgagccactgcgcccggccttgaattatttttaaacacaaaaatggtatgacctgtaagggattctgcccggttaaggttagtgagaagaaagctggatgttcatgatagtgctacagtgctcagaaagcatatttcatccttcccagataataaaactggcaatcccatggtttctactttggcaaagaaatcttgtttccccttctggacggagctaaaggaaaccattgtcatttgaccagggccaacctgtgtcctctgtttcagcctgcccctctgtgatgagggggtgaatgtaggttggtggctggggccgtctccacacgtcacatgccaattttgaactaaaagtaagggctggtcactttacctggtccagatgcattcctgagtcatctcctgttccctgacctcaaacactgcaagtcccctctcaaaaccttctttttgttacttctctaacttctcctttctgttgggttgtagcatgacccccaccccctgcttttctgtgggttctgatctcttttcctaatcctctgccttggttctcttccaccgctctgggccagagttccttcctcttctcaaaaaacatggtccttaagctgacggggcccactgaagagcatcgtaggataccttacgttgtttgcatgattcctttcaggagaggtcaagtggcctggttattcagtgtctcatagccacaaactaatggataatattccttccagatgaaaggcaggctttagtatactgtcttttgtctgtgccttgttttctgagtcttgactctcatacgggttaaatcagaagggtgaggatgggtgagtttgaatcacttgacaaccagcaagatgctgccctccccagtcccagtgtctgtgggaaatgctctcccttgcagtgggaatgacaaggcagggcagtgaaataattagcaacacatttaagttatgctataacttagtgcattgagttttaagaagtagtcattgtggctggtactctgtaaacatgcccacatggcttcccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttttttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagccaccgtgcccggtgtatttttagcagagacggagtttcgccattttgcccaggctggtctccagtgatcctccagcctcagcctcccaaaatgctgggagtacaggcgtgaaacaccacgcctggcccctgtctgtattttgcagccatacctcatggaggcctgagattggctgcaggcactttagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaactactttttttttttttttttgcataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtgtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatctattatttctttgactttttaattgtagtcatttttgcaggagtaaggtggtatctgattgtggttttaatttgcattttcctgacaactagtgatgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcggttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttctggacataacaaatagaatcacttatttcacttagcatagtgtttttaaggtcctaccgtgttgtatggagcgtgtatcagtacttcgttccttttatgcctgaatagtgcgtggataaccacagtttgcttctccatctataacctgatggaagtttgggtcgtttctactttctggctattgcatatcatgctactgtgaacatctgtgtcagcttgggttgtgtgtcatgagcttcatttcatcatcatgcagctgttgtaaaaaggactagacatagggctataaagccaagctgttaagtaaggcatgccaaaggaccacctgcttgacctagaaattcattaagcttctaatatctgagaagtctaataggcagatccttttttaaaattaagttaaacttttaattgtaaactagaattttcatttgtgaaattgaagtcttttttgcatatcacttgatttctgtaatctggacctgctgcctgtcagtcttcgtgcttttgatggacttagcacattctgagttcagaagatgctctcagacccttaggcagtgctcagccatgggcttgggtgaaaaggagacttgagggatgccgcgctctttgtcattcttttcagaggggttatgccagtggtgttggtgacttctgaacagatacttctttaacttggtataatttatgtaaattttagtgtaccagttctgagttttgaccaatgcatacagttgtgtaaccaccactagtatcaagattagaaacatctgaacgtggttttaaagcagctacctgatttcaaattggattggaatccagtttcctttcctcttttaggtttaggggtctatcaagaaaaatcagaaagctgctttatgtgtgaagggacattgtgcacaacctgagcctggctgtcaggttatctgacgttaggatctggggtttaggggaaaggatgcctgcgtttgtgcttccccttgcgggggagttgcagactggctctattgccagccagctcgcacaccatcttcccgtggagagagtgcagatccctgaaaggagcaggcaagaaggggccgggtataagcctgaccaaaggtgggcccttggacttaggtggcaagtggtaagcatgggcggggaaggcgtgagtgactgtctgtgtgtacatccgtgtgtgtgtgtgtaggggcactgagaataaagtgtgagtgagggcttggagctctggaaatctcggcagttctttggtggctggggctgcagttgctggagcagtaggtgggctggaggttcggctttgggtcttatcacttggcatgatgcgatgatggggatgactaaacaccccttggagccagttctgggagagacctaggagggaaaggggcttttgatagtgaggtatgaaattttcagccttcataactaaaaatatgcttggcgagaatagaaattcatctcccaatttcacaagccaggtgctccttgaccatgagagagctgaaaggaatgtgaatgtaaatcttctgttcctttttttttttaatgtatagatcatgtatacaataaggtagattatcaaacatgtacagcagaaggctcatttcagatcagaagttctacattcagtgagggtggtagaaatgaaaacattttattcattttgcatgttgcctatattttctaattttaaaaatacacatattgcttctttctgtattaataaaagcttattttaaatgaccgtactaatacagtttgtactgtggttaaaatatacatgaccttgaccatgagagagctaaatcttctgttccaaccgcctcattttgcagaggacaacgtcaaggctctggcctgtggaatctgatggctctgcctgaggggaggggtgttgacaacacacaagacagttggagttgtgtagccttcagaaagccctgtgtgctcatggcctgagttttcttagctaaagtttttgaagttgaaaaaacagccacaagccaaggtcacaagtagagagaggtttttttgttattgttttttgtctttctggatgtgtgagaattgcatatttccttagggcagcctctaatggaatttagtttgttgaggaggatgttagattctcaaagctgaaggaggagcaggaatattatatgcatgtctttttttttttttttttttttttttggtgccaggttcgattttgattcagagtgactccctggcctagtaaggttggctagtacagctaatctactttatgcacatggggctgcataccatgtggatcagtgattaaatagcagtacaagaccatgagggaaggaaggaactgatgttgattctgggttctatataggaaccctacaaagtagtgtttctactttatgaggaagttaggtctgtaagtgaaaagtcctggccagtgagtttggttggggtaggctctggtgggaggcttgggggagcctgttatggggaatgttaagtggctggtgatgtaaccatcgatgagagtagggaagtaacaagcctgattttgatccaagacttgtgattggaacagtgctgggagcagttgcacgggaggcaggttccagctagatacacagatttgtgctttgggcatctggagctgatgctccgggtcagaagaatgagtttctccaagacgggcctgtaaatggttccctggtagaaaatgaggcaggagggtgaagcttaggccttgattcttttttttcccttcctgtcttcccttcccttcctttagtagtggtgtatttaatttggaccagtttattcattttaagttgttgttgaacaaacacacaaagtaggcagtgggctggaaatggggacattgcgttgttcagtagacaaaggacacgttttgccttgggagaggtcactgtgtttctgagcgctttggaaggctgactgatctactagttacaatatgttgttctagcctggccattgaagtgaattttcagagaacttctgccaaagaagaacatttcattggcctaatttggatgactatgtctccttcaaagtagtgtgatgagctctgttagcatttgaacctgtcttcacattttcttctgatttgtggacacttacgaccttgctatcctgtgttctcaagtttgggtatattctgacctcaggctcgttttcacctgtgtatagagcatctagtagttctcaagggattgtattgcccctctcctgcccttggggcagttggggtgtggggtcttttattgacaagcaagggcattcctgacatttagtgggtatggctggggttaccaaagtcctgtgaaagacagggcagcctttcttaccacgttgttaaccttacccctgatatcaaggaaccctgatagagcaagtctgatttgttgggtcattttacaagttccatactagacaggcataaaggttgaaatttggaataattacaaagcattttctggggcatgtgacaggttacccatggcttcagttagtaaagagttctaacttttttcagcccctctgttgagcattttctataactttttggtgagttgagtataactggtatggaaatggtagggggtttcttttcctttttttgtgttgggtgatttagattagtggttctcaactgtggctggacattggaatttcccagggagcttttgaaaatactcatgcctggggcccacccccacatttctacttaattggcctaatgtgtggcattggaatttttaaaaattcctcaggtgattattattacttatttttttgaaatagggtctcactgttgcccaggctgaagtgaggtggcacaatcatgggtcactgcagccttcacctcccaggctaaggtgttcctcccatctcagcctcctgggtagctgggactataggggcatgccactatgtccggctaatttttgtatttttggtagagacagattttaccacgttgcccaggctggtctcgaactcctgggctcaagcgatcctcctgccttgacctcctaaagtgttgggattacaggcatgaaacaccatgcctggcctccctgggtgaatgaaaatgcacagctaggattgtaaaccactggtctagatgtttttgaacctctgcaaagatacagtaataaaggatgatgaattcagccaaataaaataattttttatttgccaccaaacatttattgagcacctgggatcaagatgactaagtgagccacctcatgcttttgctttgttttcactttaaaagccctgatttggaaagagatactactgcggagttttcagctctagctccccttcctggagtgtcttccccaagggctgggtgacagggaggccccaaatcaggaggaaggtgaggatgaagggagatgaatggtgggcaaaatggtggtgtccccataaggccctgcagacaccttcctggcagggctagcatactcagatgcccacagggaccaggcggccgcacaaatgaatagggcttgtgggtaaatgagcttccagaaacacgttcagctttggcctgtttttactgaacttggcgggtaagcctatagtgtgggaacaagtaatacttcaaatcggatttcttgtgtagtttttccttcagtttgaaacctggccggaggactttctttagcccacacggtgcctttctgttaattgtgccagttagaaaaaggggatggccactacactgggcttggccagcagtcaaagcctttgcatagatcagacaaagacaccccctttccttggcctaagggatgaggttcaccccagctcagccacccaggccagggtcctcgttcactgcacagcctggtcaattacacgcagggtggccttgtctagattgttcgttcaccagcatgggggttcgggttctgttttgtaatgtgccaacagaaccatcttgaggccatttaccaggagtgatgatttgttttatatgctttcaaaacagaaaacatctgttctagccaaggagggattgcttaatttcagaatggctcttcagattcagggaaagttctgcctggctcagtacactcaagccacctccacagtgggctggccaaccacacttcagtgacaaacacaaactgaacaaggttagtttatcttaccaagtttgaaatcagatttttttttttttttttgtgaagtagaattcagtcttaaatgttacagttctggggatataattcagaccttcgcttttaatttcctgaaaccaatttcagaatagcaaagcaagctagattattttctgccaaacgactttcccaaaggcacagttttgctaggaacaaatgagagcttaaggattcattgggccaccgctgctcggtgtttatagatgcttgtgctgctgtgggagtgtgacatggattctgcgctggtagtttctccctgatgtgggactttttcttggaggctctttcattttggccatctgtagggcttgaccaccctgacatccagccctacccaagtccttgcaagtttcagctgcatcctcactttggctagccagacccctgcattctgagggggaggaaaccacttctttgggggtgaacacctgttggtgacttttggaaggggttgctctagttcttagggctgtctgaagtcccgttgctttttctcttcttcctatctcaattgctgataccccaagggtctcagggctgtggcccatttatttctacctatacctgtttggggatttagggttacactctgtcatctagttttgttccagatgttgtccatgagttttggctgggctatcaactgctctgcttgacaattccgaatattaaattatgttttcactgccacttttagtattctgtttgctattgttaaagttgaaaacgaattttgggcaggtgtattagcttgctagggttgctgtaacaaagtactacaaattggatagtttacaatggcagagatgtattctctcacagctctggaggccagaagttccagatcaaaacgtgacaggcccatgcttccccagaaggccctaggggagaatccatccttgcctcttcagcttctggtgcgcttctagctgtcctgggcttggcatgttgctcttaatcactccaatctctgcctccgtcttatgtcacctgcccccttttctccctgtatcttctcttctgtctcttataagggcacttgtcattgggtttagggtctgggtacctggataatccagatgcttttatctcaagatccttaacttaattacatctacaaagaccattttccaaagaaagtcacatccccaggttctggagattaagatgtggatatatctttttggtgctaccattatacccactacagtgggagagagtgaaatcttctgatttttaaatggcaactgatttacacttttaaaaagtctgtgcagggactgggtgcggtggtccacgcctgtaatcccagcacttcgggaggctgtggcaggtggattgcttgagctcaggagtttgagaccagcctgggcaatatggtgaaaccccatcgctaccaaaaatgtacaaaaattagttggacatgggccgggcgcggcggatcacaaggtcaggagattgagaccatcttggctaacacagtgaaaccccgtctctactacaaatacaaaaaaaaaaaaaaaaagccgggcgtggtggcgggcgcctgtagtcctagctactcgggaggctgaggcaggagaatggtgtgaacctggaaggcggagcttgcagtgagccaggatcacaccactgcactccagcctgggctacagagccagactctgtctcaaaataaaataaaataaaataaaataataaataaataaaaaaaaacaaataaataaaaattagttgggcatggtggttcgcacctgtagtcccagctacttgggaggctgaagcaagaggatcacttaagcccaggaagcagaggttgcattgagccgagattgcgccaatgcacttcaacctgggcgacagagggagatcctgtctcaaaaaataaaaaaagtctgtgcaggccagaataagtcatatctgtccactttggcctctaaacttcccgtttgtagccttcattcagtggccttgggaacacagttctaagtcactagagatagactctttatgcatagtgaaaaaatccttaacttcccagttctagtttcggcactacttagtttatggcagaaattctaatgtaattttcttggcaaatcacactgcaatcagctgtgactctttgtttttttcttttacctctgttcaggtcacagagatgtttcattttgatatttttcccctcacaggagccagccttcagagggctggtgggaaagtaaagagtaattcctcttgtcatatcttggttctttgttttacatttattagggaatgcctgctttgtagatagaactagagaagaaaaaattgcatttaccccttattctaagtattgtaatgttggatgttcttgaagatcctggcttcaagtgaacctgcggaggttaatgtactttacctgggaacactgattgcacttttgggagtaggacactgggcaggatgggagacaggaggattggcttctgcgaccatgggggtggggtggggagaccgacaagccagcaggttgtcccatatggaatcgttgtccagtttctaccatttagagctatgttactgaggattactgttggatatttttttccagttataaaagcagcacatcctttttgtaaaacatggggaaaaaaaagcttgtcatttatattactcatcagcagtggacaggtatcccctttctagtaccatgtgtcctcattaatttatttaacctgaagtggaatctcatttgttgtacttgaatttatttgcatttctttaatttctgcttagggtgaatattttgttatgctgtctctaggctgaatatgtctacatccttggcgcagctatttgtggtcggcttttgtgttcttaccgtcgtgtaatctggtggtctgcgttgcctttccttgcagggtggagaatgtttatcgctcatgtcatgacaagggataagtgacactgacaactttgttcaggttttttaatttttatttatttatttatttatttatttatttatttacttatttatttatttttaagctcagtcctcaaactgtgcctcattggccttccttctgaacgtttctttctgaccatcttgccttcttccccttgttctccagctgatggtgagaccattctaaaaggcctccagtccattttccaggagcaggggatggcggagtcggtgcacacctggcaggaccatggctatttagcaacctacacaaacaagaacggcaggtgagcagtctccagtgctgttcttcatacctggtcacttatgagcagagagggtgacagagtggaggatgggggtggcatccggcatttttttttctcctttgacatcttttaggatgggaatggaacttggtgcttctcaaccgtagctgcacatcagaatctcctggtagcgttactgaccacaggttcttaagctctcatgtatatagagattgacaggaggccaaacatgtttcccagacaagttttttgttaagactgatgcccagagtgggcataagggaggcagcccaggaaaagttttgtggcttactcccccaagggcagctgcaggtgatgttttgaagggagtgacgtgaatagttcatgaggtagatgagtgtcattacaggtacgcacccagggagtggtgtgcagactcagtgaggcctcctgctaatgtatacaccctgaagtggctggtgagccccgctcttggcggggactttagcgtaatagtaagacgggcaggatcgctcactgggctcctgcaagcggtaggtcaactccctggagtaaaaagtttatggtagaactcagcctcttaagtccctggagtaagatttaccataggaagctgcttatcttagtgttttccaggtctctggtcagcagagatgatatcggaggggctggggtccagatggatgggttggttggggtgcccaccacctgtggggacccactagtttgcagcagaggcccgtagggggcatgccgaggccttctcgctgcaggatgctgagctgcagatgcccttgctcagctcgaagtagggtgggtgcaggctgaggttgcctgctctaggatggccagcagcagtgctgcagggccccaggggcagcccgaacagagcctcaagcagcgctttgccatcttcctggctcctagagcctggtatttctgtaagtaagtgtgttattacggttggggggagcccaggtcccttctctactctgtttctggagagctttcacgaaacactcgtgcatttcccccagaaattgaggtcacagggcctggacatctggatttctccaaagccccagtggttctatgtggccaggaccaagaacccctggtggcataagcagtttgaaaaggcaggcaatgatctcctgggcccctaccgtaagagttcttgaagcaataagtggatctgcggcagggcccagattccatttccaggaagctcccgggggatgctgatgctgctggacagctgaccacacttggagtagcactgttatgactgatgatcagctaccgcagaccatggtaaaatgcagaagaaaacctaaactaagaaatgactgataacaagaaaccagtgcgttgagctcttggtatttccttaaatcttggtttgtattatatctggactggcttagtatgtaaaactactaattaagattcttagtaatttgcactattaatttagaaatgtaatagggtgcagtatgtactgctcaggtgatgagtgcaccaaaatctcacgaatcagcactaaagaatttactcatgtaaccaaacaacacccgttccccaataacctatggaaataaaaattaaaataaataaaaatgtgaactccaggatggggtattttcgatggcttttattctgttacctcagtgggtacccagtactggaattccacgtggcttccttaatgtcccactttttctctctttgtttctctattaaaggaaaaagtacccacctccatgatattccagagacctagagatgagggaaacctgtactttttgagctcactgccccttccactattctctctataagtctccatggccaacccctgtggcattaattggtgttctctatcctgatacctctcaaagacatcctaaccccttcttccccaagcccaggcttgtatttctaactgtgtagcaaacctccctgtgtgtttagtcgatacctcaaatgtatctaagatgatgatttcttcctcatatgaacaccaccaccaaaccctcctctcccctgtgtccttttcttccctgctgtgacccagttgatggatggtctcttggaagcagaggctgtagctgtcctagagccctctggctcctgcaggattacactgagcccctccctgtacctgccgcctctcactgtttttactgtggtccatcttttggggactacagcaaattggaactcatcatccaccgcctccggtggcaggctcctcagccagcaccaggtgaaaagttgcacttcttatctcctaaaggcctttgctgctgggccctgcctacctctgtatgacagttattgaagtttctaccataggcaccaattccagttgtacaggagacttagaattcttcccagaaggggtttttgagtgacaagagctgttcggaaactgcttcgaaaagcaataaacaaaaacaaaaaccccaaatgaactgcttagggttttcgttgttgttgttgtttttgagaccgaatcttgctctgttgcccaggctggagtgcagtggcacaatcttggcttactgcaacctctgcctcccgggttcaaacagttctccacctcagccttccaagtggctggaattacaggcactcaccaccacatccagataattttgtgtttttaatagagacgtggtttcaccacgttgcccaggctggtctcgaactcctggctcaagccatccacctgcctcggcctcccaaagtgttgggattacaggcatgagccaccgcgcctggccagcttagtttttaagagttttctacctggtctccttcctctctcacttggtcaactggtacccaccccgaggtgcctgtcctgaaacctcacctctcctacccatgcatgggcttggggaaaggacctgagccaccttttattcaggttctctattccctgcccccggaccccaggcacactttcccccctctatttctggttttatccctagtagcaccttaatccttgacactgccttctagcattctctgtgttcatgctagaaccacccaagtggataaaggggaccttacttctctattgttccttccccctctcctctctgctgctggtgaaggagggaaaggaaagatgatcctctcattctggtgtagaagagtttgtggactctggggaagaacttgatttctgaggtcacttaagggctgaaggtgaaaaattaactagttttgttttattttaaattttttatagagacagggtctcactctgtcgcccaggctggagtgcagtggtgcgatcatggctcacttaggccttgacctcccgggcttaaggaatcctcctgcctcatcctcccaagtagctgggactacaggcgtgtgccaccatgcttagcttattatttttagtttttttttttttttttttaatccaagcacactgtctgtattctctgaacagaattgatcttctaatttagtatttttcaaacatttctttacctataatttgtagtaggaggtaatcataaccctggaaataacacatctgtgtaaatgcaaaacaaatacatgcataggccgggcatggtggctcacgcctgtagtctcaacactttgggaggccaaggcaggtggatcacctgaggtcaggagttcaagacccacctggccaacatggtgaaaccccgtctctactaaaaatacaaaattagccaggtgtggtgggacacgcctgtggtcccagctactcgggaggctgagacaggagaatcgcttgaacccaggaggtggaggctgcagtgagccgagatcatgtcactgcactccagcctgggcaagacagagtgcgactccatctcagaaaaaaaaaaaccaacatgcatataactaaaacagaagtttcatcaaatacatcttggtgcatgtgatacactcaaatatgtttatttcattaagaaaaagggctggtcagaaaattttgtgtaaaggttgctgtcacatttttaaaaatctttaaaaatgtaaaccattcttaacttagcttgcaggctttacaaaaacatactgtgggatggattaggtttgcaggcagttggcctggattttccagagtgcctactaaattaatttacctaccaccagcctgcagttaggaaaaaatggctctggtttgaactctgaatgttaatgagaaaaaccagtttacccttctccacactcccttcctcttaaggcagtagttactaaacctggcaaaattacctagagaacctttttaaaaaccagattcacagaactgctactgaatcactttctgggcccaagaaccagttttgaaaaccttaatatttggtaatgccctctaaaccttccacaaatgattggtagtttctccccgcaagacgcagccctagtaagaaagcaaaaagcttaactgtatacttttggggaaataaagagcagtggtcttttaattgggtgacatctctctctctctctcttttttttttaatgccccgatacaattcttaagcttaaaattatattttcctttgtagctttgccaatttgagaatttacccacatggattggtgttgctggaccttcagagttatgatggtgatgcgcaaggcaaagaagagatcgacagtgtcggtttttcactttcatttactcagtgtttaaggatcatagtatctgcttagcttagtgttaaaataatgttctcttcattgcttactttccagttaattttaaactttcctccctccacataagtgattttagaatagaagtagttgtttagttgtttttaggaacctgggtgtcagcgttcccttttaactgccttagtatgagtaatcttattttccactggagggaatagaaaacctttaaccaggattttatagctgcagtaccctttagccttcctcttccgtgttactttgttgctaacttacgctaaggttaggtcagcaacatgaagggatagttggtatgggagagtggaattgggccaggcgtctacaggctgctagagggtaggaggagggacaggtcaatcttgcacagctctgtcaacatggcctcagtcgttgggtctgtaatttagttcttccatgcagcttattctacaagcccattgatttttcttttaattgtagattttgaacaaagtagaggaaagaatgaaagaattgagtcaggacagtactgggcgggtgaaacggtaagtccactcttgaatgtccttttatatttaatcgattgaaacaatcatagttggctgggcgcggtagctcacacctgtaatcccagcaatttaggaggccgaggcaggcggatcacttgaagtcaggagtttgagaccagcctggccaatgtggcaaaacaccgtctctactaaaaatacaaaaattagctggacgtggtagtgcatgcctgtaattccagctacttgaaaggctgacgcatgcgaatggcctgaaccgaggaggcaggaagcagaggttgcagtgagctgagatcatcgcaccgctgcactcctgcctgggtgacacaatgagactgtctcaaaaaaaaaaaaaaaaaaaaaaaattcagaatggcagtgtggtccccagtagtgtctgcttaagatgtggaaaagatcaaactcagcacctccttctggcaacatggtgaactgaactactgggcccctcacaccaaaacaagacagtgtatgaacattcatgtgcatggatgcacacacacaaatgctaggtaaaatgaaactaaggcagaaaggggatatggaccaactccaaggagttggaactgcctaaagtggagacccaggtagagctgccacctcatcaaagggagctagaaaactcctgacttcagttcgagaccagcctgaccaacatgggtgaaaccccgtctctactaaaaatagaaaaagtagccaggcgtggtggtacgtgcttgtaatcccagcttctcaggaggctgaggcaggagaatagcttgaacccgggaagcggaggttgcagtgagctgagatcgcaccactgcgctccatcctgggcaacagagtgaaactcgcctcaaaacaaaacaaaacaaatacctgacttcaacctttccaggaaagagaaaaggtcactttttctccttcaggctctaggccccagagtgaagttaagcaattttaagagacttccgacagggtggggtgataagaaaatttgcctcaaggcgttcaaagaagaaaactttccaagatactaagaattgataggccaccaactttaagctgccataggcaggttattttcaagtgatcatgaggaaaatgaagctctccctatccagtgggatgggcactagccccacatggctatttaaagttaattaaaatacacaattcagttccttagtcacaatagctagtggttagtgtctgccatgtgggacagtacaactacggaacattttcatcatccaaatttctatcggacactgccgaagtgtttgccagtggtgtcagattttaaaagaatgcaattcggacatcgtgggaaggaactagtgtctggtacatcatgggaattaagaagtgctttggatacacagcatgcaaatgcaggacaatttactcttgccctgccttggtggatcctcatcaggccttaaggcatagaaggcctgtcccttgctcataaaattaacctcagttgcagagaccaacacagagggacttcctcattgctgagcaacggaaatacaggtttctccagttcatggcactttccagaagaaggaatccttattggcaagtgttaggatgtttaagtacttaattactcagcatgctaagtttgatcagcccacaagaaagctccagagcagatgtaagataactaggtaattgtttaaccttctgtagttaaagaggaaagcaggaaactgaaagtgaaaagaagacgccacagtatagaactatttttttgagatctgttagagcactcaggctcttttggagcacccaagctcagtttagggtccccagccatgtctcttacccttcaccttcctttaaaaacacatccacacccatatacccataccactttttggacatttcatcttttcctgttggcagggttttccttatctgcacccatttggaatgaacaggttccccactgtcagaaagggtcttaactttatgataatgaattggtccacatcaaaatgtggtctgatttttatcagttgcctctaggagtgagtaaacagcatacatttatgggcttcagcattcatgagaagtctggttcttttccttttttggtataggagttttctaagagtggagttaagctttagatcttcaaaataccttgcttatgcttgtcacagtttttattatcttttcatgaaataaggttgacgacagctagaaattgggtataccttgttgtaaaccctttgttactggcctcaaaaggacaaggattgctatccttttttttttttttttttttaaatctggagaataaagatcagaggttaaatgttagagattaaatcattaacaaataacccagtaacattatctgaaattattcccctttgataagttaagtctgaattttcgactaagaagctatgggatgtacttgaatttatttttgttttctactttcaagtgaaaaaacaagaaaacaaggtcacataaattaactttgattttaaaaggttcttgcaatttacacagtatacctaaggcctgggctataatctacctgaattggtgtagtccagtttcatttttcagcagtgaaggttgaaacgagtttggtagggtgctctacagtacctcctggtagcccgttatagggctaccagcgagatgccctttaatgctaggttgagcacttcatcagggtaatggcatttacatcctgttaagatccttctttctttgctagtctttaaaaaaaccatagagttacaatgtaggaaagagctcttcaccttagccaaggcactattgacacaattgagaacaggcactgtttagtttcagtgggtttgcctgtagtgcagtaattgccgataggtggctggctgtcaaggagagggtagtcttcctcccctggaagtgagtgactttgtcgttcatccaatgccatgggtggctcactctcacctcactccccaccatcagccaggggtggaagaggcttcctccaagtcctgttcgcctgctctctagcagttgtcctgattggtgcttcacattttacaatttacaagaaaaaccctctagaatgcctcacattctgaaagctgaatttgttcacatggaaggtgaagaagtggttaaatgaagagttgtcaggatgacatgaatttatgggagtttgccttttcaatctcggtgttctttatagatgttagtattccctcatagaaagccttgttaacttgtaacaggtttagactgtactcttggaagctggtgagcagggaagggaaagagactcataagagtacgtcaggccgcatatcccagcattttacatgtctacagctgtacatcatggcgttttaatgttgaacactactgtgtttgagaacacatgactcacgcagttgtgttatgtatgcagtgagctctcgttttctttgtgtttgggttagacttgccaagccccttttccaggtcttttttttcctgtcatttagtgtcctctgctggtaccttctagtacattcatcctgtgaaaaataccgggtatttacaaaagaatgaatgaaaaaatcatcattttgcagcctctgtagtagtaactggttcaggccagaatcttctgcatgctaaaaccactggtaaaggtttgttggggggtgaggacttctacctagtttcagagcaccaccccacagcctgcttagtaatttcagagggtgaaaaaggtacctttgcaaatggagagagcccatgaataccactttaaccaagtgatcacagacttagcatcaccaataataggacagatacacatcttgtgttcccgatgtgatgcctgtgtaatatatgtcaacctgattctaaccatgaagagtgagagattatcaggtaaacccacgagtcatttttcagcagaatagctggtctgtacttggagatatcagtgtcatgaaacataccagtaaaaaaaaaattatacgttacatgaggataaaaaagaaaaaaaaaacagggaaatgcagtgtatgagcctttattcaagagcagaacatctataaaggatataactggggacacttgaagatggactctgtactagataaccatatcatacccatgtgaactggtgtaaatgtggtaatgtccatgtagttatgtagatagtcttaagagacagatgctgctggagcatttgaaatatgaagtgtgcagtggccatcttctccttcagctttttgttagagaaaatctaaagcatgacaggattttttaaaaagtgaactgtgtacaatagttgtcaacatttggtggtggccgtgattatataaaactaaaagcccaagctttggattcgttttgtgcttgtcaaaagtcggcagtcatgtggctttcttttgcacactcttcatcctagctccacttgtaaggcagtgttctagtaaggtacatttctgtttttctctttttccagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttagtaagtattccatccctgccccgatcacgtaacaaagtggtgatgtgttgaatgatggtgttttcctgacaattactactgtcgtggatttgtttgagtttgtttttgacactgctggtttttgagatgcacatttatgtcatattaacctgtggattgtctgggctttcacataaactttgtcttgacattgcttccttagtgatgagtatttggattgtatttcaaaagaaaatgcatttgcatatttaaaaaaaaaaacctttttgttacagaacaattcaaacctaagtagacaaactagtgtgatgaacccacatgtacttaccatcgagtgtgaacaattaccacctcctagccagtcttattttacctaaaccccagtccactttgtccctctcatattattttgaagcagctcacagacatcatattatttcatttgtaaagatgtaattgcttttagttattcggtatattgacacatttttaaggctggattttcttcccactgactaatgtccatttgtattaggtgtcagatgatcagggttgatgaaaaagtcctcaatggaaaaaaagcttgcaaattgttcacagttttaaaaaattgaaaatgaaaaatttacattttggtctagatcccagctcttcagtgtggtggggccaggtggtttgtgtgttaaggtagactcaccatttggatctgtttctcctccctagatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagatatcctttgttgtataagagaacaagttcagtgggcttcttttgtttccttccttcagtgtctcacaactcaaattaatgttaccacagactagaggcaaatgtgttacctagactgccttgaacagacaatttagtaacagtacccttttatgtggccatcaacaaagaaataatcagctgggcacagtggctcatgcctgtaatcctagcactttgggaggccgaggcgggtggatcacctgaggtcaggagttcaagaccagcctgatcgacatggcgaaaccctacctctactaaaattacaaaaattagccaggcatggtggcgggcacctgtaatcccagctactcgggaggctgagacaggagaattgcttgaaccctaggtggcagaggttgcagtaagccaagattgcgcaacttcactccagcctgggtgacagtaagactctgtctcaaaaacaaacaaataatctacctagttgaggattaaagagcaaaggactttgatactgtgtctgctgcctagcagtttccaaaatggcttctctaaagccatctcatgaggagaaaagaagattaagttccttttgagtgtccttagtgtgaaaataaagtcactgcctcattcatcattttgttaaatttgtgatacccaagttagtattataaaacctttgtttgtcttaatcctttctttaaagtattactatttcagaattctttgatatacccaaattctccttaacctgttgcggacattgaccaaatggtgattgatgggtgtaagaaatacatgcgaaaaacgtgtggcgatgtcttagacaatcttaaaggagactgctatcaggtaattgttttctggataatgtagttttaagtgaactaataatataagttattgatcagaattgtgccttattaaaacagcttttagtatagttggttgagaagataaatacatcatctgtctcttcatatgagttatatgtatatttgtatttagggtgcacacgtaccaatgatgggaaagcaccaactccagattctctgaattaaataaaattaattctttttttttttattatactttcagttctacggtacatgtgcagaatgtacaggtttgttacataggtatacacgtgccatggtggtttgctgcacctatgaacccatcatctaggttttaagccctgcatgcgttaggtatttctcctaatgctatccttcccctagccccctacccccgatcggccccggtgtgtgatgttcccctccctgtgtccatgtgttctcattgttcagcttacacttaggagtgagaacatgcggtgtttggttttctgttcttgtgttagtttgctgagaatgatggtttccagcttcatccatgtccttgcagaggacatgaactcattcttttttatggctgcatagtattccatggcatatatgtgccacattttctttatccagcctatccttaatgggcatttgggttggttccaagtctttgctattgtgaatagtgccgcaataaatatacgtgtgcatgtgtctttatagtagaatgacttataatcctttgtatgtatacccagtaatgtgatcgctgggtcaaatggtatttctagtcctagatccttgaggaatcgctacgctgtcttctacaatggttgaactaatttacactcccaccaacagtataaaagtgttcctatttctcctcatcctctccagcatctgttgcttcctgactttttaatgatggccattctaactccagcttgggctgcagagcgagaatgtctcaaaaaaaaaaaaaaatcttaataaaaaaaaaaaccttaataataataataaaaaagaaaccttagtagtaaaaatcaagtagtacacaaagctaaagattgcttttacatatgtacaaaatttccaagtaaaataataagctaaatctggcaaattaagtctatattatgctcaagtaggatttagttagaagtgtaaagatttcaattttaagaaatctgtcaacttaattcgttaggtgaataatttaaaggaggaaaataacagatgacaaagaatttgagaatatttagcagtcattttaaataaaaactaatgcagtatagccatgtaaaattagccaggtgtggcggcgtgtgcctgtaattccagctacatggaaggctgaggcaggagaatcgcttgaacccggaaggtggaggttgcagtgagctgagattgcaccactgcactccagcctgggcaacagagggagactgtctccaaaaaaaaaaaaaaatatatatatatatatatatatatttccatctaacaaatctgtacatgtacttcctgaatctaaaataaaagttaaattataaattacttgaataaaataaaattgcaatagagatgaaactacctgaacgttaatagaaacttaggttgtggtaaatagaaaaatagaaaatataatagatagcaaaagccatttccactgaaaataggaagaagatgaggatgcctattatctttttcaacattattttttgaggtagctgagatagtaaagtagatgaaaacagtataaatctaattatttgtagatgatgtgaatactagaaaatccaggaaacttacgtaggaaattatttgaattaatgagaatttgataaagtgattggataaagccagcctagattttttctctatactaaatgctaactcatttaaataggatttccttcccacccatttcctttcaaagtaatcaagtgttaaattcctaggaatatatttaacaagaatggtattgtgagactggtatgaattatgttaagatgttattgaaagacatcaaagtctgaatatgtggagaggcatgctgtatttcttgtattgaaagaacaggccgggcttggtggctcacctgtaatcccagcactttgggaggccgaggtgggtggatcacttgaagtcaggagttggagaacagcctggtcaacatggtgaaatcctgtctctactaaaaatacaaaaattagcccgacgtggtggtgggtgcttataatccagctactctggaggctgaggcaggagaattgcttgaacccgggaggtggaggttgcagtgagccaagattgcaccactgcactccagcctgggtggcagagcaagactccgtctcaaaaaaaaaaaggaacaatgtctattcttcccaatttattatgagtaatcccaaggaggggggaggggtttaaaagtagaccaactgattttgaagttgatttgtaaaaataagtatctaagaatacccaagaaaacttgaaaaaagaatcatagtgtgaagcgaaatatgtcctatttgttgttaatgtactataaggcacgataatcaaataggaagtatgaaaggaatacacaaggacctaggaatgtcaaaggaacttgaacaggtctgagtatgtattcctacacactgctaatatggtctaagatacatttcagttgacttgggaaaagcgttagttgagttagtgtgtgatgccggtataagaagttatccatctgcatgagaaccaagttagctaacaatagaaataggaattttggtgacttaggctctaaatgtaaaaactaatacatttaagacaatttagagtacttaaccttggagttcagaaatctcttaaagataggacactcaaactgttaatggtattataatgttgtcattaccaagccaaaagtcagactagaagaaagactagtaacaagcatgacagggaattgatcccttgaataatgcagagtccctacaacttagaaatgaagttagctaaatttaaaaaggtatagaggatatttactggtacttctcagaataagtcaaataacctgtaaaaagtaccacaagacaggccgggcgcggtggctcacacctgtaatcccagcactttgggaggctgaggtgggcggatcacgaggtcaggagatcgagaccatcctggctaacatagtgaaaccccgtctccactaaaaaaatacaaaaaaaaattagctgggcgtggtggcgggcacctgtagtctcagctactcgggaggctgaggcaggagaatggcgtgaacccgggaggcagagcttgcagtgagcccagatcgcatcactgcactccagcctgggcgacagagcaagacttgtctcaaaaaaaaaaaaaaaaaaaagtaccacaagacggtcaaccctgttggtggcccaggaagttcttgtgaaaacattagcaacagacttcacaaaatttagtagaggggcaatatctcatgctggggaggttgtggggagacaggtgctcatatgcattgctggttggcgtgtgaattgctatcaaaaccggaacacacggcttctagccggtgtttgagcacacagcccacagttaaaaaggtgtcactacaaggttttattatagctgtgcttgtagtgaccaaggcttggcaatgacaacagaaagaatgtttttagtggaatggtgtattttttaaaatgtgtgttattacctggagagatgttgggtgaaatgttcaagttccaaatgatgtgtgggattcaaattttacaaaagagaacatacatttgtgtttgtgtgcaagtattcgtaagaatctgtgtgaacgtatggaaaaaatatgagcatatcaaacaggattaatacatggattgaaagcaacggtggtgttagtacctcctatatttttccatagttggacttgtatgatgcattgaggcaagttataaaacaataggacagaaaagtcccagtttcttaaaattataactgtgaggctataagaagaatgatgagaaataacatgggataggttatcttagggaattgtggtgaactttttttaattttttttgagtcaaggtcttgctctgtcactcaggctggagcacagtggtgcgcgatgatcatggctcactacagcctcaaactcccgggctcaagcgatcctcccacctcaacttcctgagtagccgggactacaggcagataccactaggcccagctgatttttcttttttttctagagacgggctttcaccatgtcgcccaggctgctctagtactcctgggctccattgttccgcccacctcaacttcccaaagtactgggattacaggtgttgggccactgaccccagcctggcaaactcttaaactcttggtttctgactattatatttaatttttcttttacttaatgtattttttttttgaattagaaaactaaaagatgacagtaactcctgtttagttcaggatgttgcttagatccagatgtgtccccagcatagagcctcagtacttcaaagatacagccaacctcaaacttcttttctgtgttaactatatatgatctgtatgggaattccagctggtctctttattgactctgatggtgggagctgttatatatagctttattagcagtagcccaagcgttagagaaaattgagaaataacatgttaatagtttgagtaaggtgcaaaagtgaatccataaacaatgaagtcattcagtgcttagtataaaagaaaaattaggctgggtacggtggctcatgcctctaatcccagcactatgagagtctgaggtgggcagattgcttgagcccaggagttcaagaccagcctgggcaacgtagtgagaccctgtctctagaaaaactttttaaaaatagtttattaattaaaaaaataaaaattaaaagaagatgatacagatagtgataggagaggcagtatagattagagatgaaagtatgaagttggctttcagatagtaataggtatacttcgtggatctatgggcaagctggataacacctcaagtttgtttctgcattggtaaaatgggatgataatagtgcctctaggattgttgttttattgaaatgagaaggcatataaagcatatatggtaagcacttaatttttgctgttaacagacatagatgaaagttttttggttcctgtagcagttgctgtggatagctgtggatataagcccatacttggcgcttttttcctccttcctttactattgttttttgtttaactacatccacatgttggctcactcatctattcctgttctttctggaaggttctaatagaagactgtatcccggtactgaagaggtacgccaaagaagggagagaatttgattatgtgattaatgatttgacagctgttccaatctccacgtctccagaagaaggtagatttttttaaccaagatatttatgatggaaatgtttctcttggcaccatgtgagggtgaaaggatcctagagattgtgtagttctctcacgtttttgaaaaagggagttaaattgaggtccatggtggaaagatgactggatttggcttcaattcctgttctgccactcaatgagtgaactaattcagtcatttgaaacaaaaatgaagtaaaatgactcattacattaatgagacagtaaatcatttgacaatttatttaaattatgtgattttcaacctgtattggtacaaactggtcacttatctaagcaacgacatagataattccctttctcaaaccagatgtttgttccaaatcacagctagttcgtgtttttttctataaactcaagttcctgctgagtttgcaggctctgaatttctctcaggattttgctgcttgcccccttatttaaagcagttttctttcacgtttcagccactgcctttgtgtcaaatctattggtattttgagagcgagcagtgctaggtggatgtgattttggcatccaaaatcaatttcattatcgttcatgaacaagctctttgaatagtgggtcttacactcgtggctctttttctttttcctcttttggtattgagtattcgaatattttacttcagatgttgtggatacatacaaacccatatttatgaaacttgttcttttaaacattcagattccacatgggagtttctcagactgattcttgacctctcaatgaaagtgttgaaacaggatgggaaatattttacacaggtaggctacttaacagttttttccctcaaaacgctctaagactttcctgttttgaaatctgaatgcacatttttgaaatgtatatctattaaggatagagcggcatcatcggattatgttctttcaaacagtaagcttctacgttgacctgttgtctgttgggaattaatgagttatcagccctggtctttcgctgtagtatgagctgctgccaccagatggagacacagactgattttcttttttcccctcccctcatcaacatacacttgatgacaaagctctggctgtactgtgaactcctgccaccagatggaagcagattgtggtgtttttctcattctctaggggattctaaacttaaactttaaagattacattaattggggttaaaaatatacatatatatctcctattgaaatccttaacaaaattttgaaaatgacagcaaagacagctaattgataatccagtctcttggtacaaaattccttgatgcataaacataagataagcacttatgtagcattgcactctggatctctgaattattctgagtttacaggaaaatcccctccgccattttttaaaaaaagtactgccagcctggacaacatagtaagactccatttctacaaaaagtttaaaaaattagctgggtatggtggtgcatgcctgtagtcctaactctggaggctgaggtgggaggattgtttgagcctgggaggttgaagctgtagtgagctgtgatcgtgccactgccctccagcctgggtgacagagtgagaccttgactcaaaaataaacacagtattagtatactgtatttaaaagtcaggaagaggccaggtgtggtggcttacgcctgtaatcctagcactttgggaggccgaggcagttggattatctgaggtcaggagttcgagaccagcctggccaacatggtgaaatcccgtctctactaaaaatacaaaaattagccaggcatggtggcagcagcctgtaatcccagctactcaggaggctgaggcaggaaattgcttgaacctgggaggcagaggttgcagtgagccgagattgcaccactgtactccagcctgggccatagagcaagactacatctcaaaaaaaaaaaaaaaaaaaaaaaaaaaagtcaggaacaggtagaggttttcactttaaccttctgaggaggtgtctgccagcagaccctatcctggacattttatggaatctgagattactaatgctgaaaacaacttagcatttctgagagacatcttgattcaggctccagcctatcctgttgttcccctcttccctctgcgtgcaagacctgcaagcacattgtgcttaatcttggactttgcgcttggcaaaattgttcagaggctttgaggacagcaaagcactatcaatgaatggagtgtctctgccccccacaacatttagaaatgatttttacagacatgctgtagatggatataactatttaaagcaggagtctgcaaacattgggccaaatctggcctcctgcttgcatgtttgtaaagttttcttggcatgcagacacgcccatttattacatagtgtctgtggctgcttttgtactgagtagttgtggtagatactgtatgatctgcacagcctaaaatattttctatcagaccctttacagagaaagtttgctgatccctgtcttataggaaaccagtgaaacctgctcaaatgaagctttcttattgtaaagaagcaagttggacttatgatggtttttttttttttttttgagatggagttgcgctcttgtttcccaggctggagtgcaatggcgcgatctcagctcaccgcaacctccacctcctgggttcaagcgattctcctgcctcagcctcctgagtagctgggattataggcatgtgccaccacgcccggctgattttttgtatttttagtagagatggagtttctctatgttggtcaggctggtctcgaactcccaacctcaggtgatacgcccccctcggcctcccaaagtgctgggattacaggcgcgagccactgcgcccagccatgatgggtactttttaagcagagcatatggaaattttttcttttcatttttttgaggtaagttcttggtctgtagcttaggctggagtgcagtggcacagtggcactcattgcagcctcaacctcccagactgaagtgatcatcctgctttgccctcccaaagtgctgggatttcaggcatccattgccatgcctggctaatttttgtagagatgaggtctcactatgttgcccaggttggccttaaactcctagattcgagtaatcctcctccatcagcctcctgaagtgttgagattactgccatgagtgaccgtgcccaggcagaattttttcttttaggtttctgcaaatacataaaaggaaatctcaagcagcttaaattaatcaaggaaaaatgtgaggctctgggatcttgaacaaaaagagactgaaaaaaatttggatccactacaaactagtcagtctgtagtacaaaaggcaggacaaaagaagacagccacactaagtccacctgttgtctactacagccgagtggctgttcttcttttgttctgaatattggcatggcaggctgcctcctatggagagctgttatcttagtatgaaaggctaatagaatacttgcttagaatactaccacagcccatttgtgaatattaatgacccaggctttgatatcttgcctttgccaatagactttttaccaaaatcaaaaggattgtatgcccagggctgtcttggtttctaagaattgtccaaaagacatatgacatgttttctgtccccatgttcattacagttggaaccacaaaacagtctcattatgtaacacctggggttcattcagtacatttggtgattgacactgtcacatggtaagatttatgtggaccggcatgtatagccctttcaagaagtagtaattaagtcaaaaagcaagtgatttgactcaggatgtgttgatgtagttgccacagtgcagtttttttttaactgccaggtgacacgcttaggaggtaacccagattcttggcatgcccacccgctttgcccaagtgtgcagcttagaactggagtcaggttggccgggtgcggtggctcacgcctgtaatcccagcactttgggaggccgaggcaggaggatcacgagatcaggagataaagatcatcctggctaacgtggtgaaaccccgtctctactaaaaatacaaaaaattagccgggcgcggtggcagacgcctgtagtcccagctactcgggaggctgaggcaggagaatggcgtgaacccaggaggcggagcttgcagtgagccgagatcacgccactgcagtccagcctgggcaagagggagactctgtctcaaaaaaaaaaaaaaaaaaaaaaaaaaaaaaggagtcaggttaagggtgggatgaaaatgttgtgttttacaaaagctaaatgttcccacccaaaactgctagctgtgagttcgtgatgtcattggttttactgtggctgcctgaaggcagccttgtcagcatcccaggaagctggggaatgcatcgtggagggacgtgggaatcaaagtgggccaatagaatttgaattggggaggaagtgttttcatggaacctaggaggcggatcctgggacttgaccttcctctcttgtctccccacagccccatttaaaaaaaactgtaagttatatttctctctcctttctgcttgccttctagaagcaacccatctttggtctcacttttttccatttctgcattttatagatggttcttacatgtatgatttcctaaatcattatactatttaattttacttgcttttgaactggataaaagttgctaaggatgtattcttctgtacctgttactgaggtgtcatgtgcctgtaatcctaactactcaggaggattgcttgagcccaggagttcgaggacagcctgggcaacatagtgaagaccccacctctaaaataaacaaaagcaaatgtcacctgtccacacctaacatggggaaaagaactttctagaactgaagctatcgaatttggatttaatcccatagtgaagcctcaaaggggtaaagaaaccaatgactaataaaatctggactttgcaggattacgggtaaaaaaagaaacagcttgctgaaacactgaaactccctccacttaagagagaaaatcattggctaaaatctgttaaaaccaatatggccaattagaatttgcatagaacaagcttgctgatgtcacagcctaagtttccaccacttgcttcatgctaaccacttccccgccctcaagtttgcacacaagacccattagtgggcataaagaaataactatacacgcctgaggattttccagatctaccctttgctttccatccacgaatcaatcacctgcacatctcagaacctaccctttaaacttttttttgttgttgttgttgagacagagatggagtctcactctgtggcccaggctagagtacagtggcttgatcactgctcactgcaacctttgcctcccgggttcaagcacctctcctgcctcagccttccgagtagctgggattacaggtgtgagccaccacacctggctaatttttgtatttttagaagagatgggatttcaccatgttggccatgctgctctcgaactcctgacctgaagtgatctgcctgcctctgcctccaaagtgttagcattatagatgtgagccgccacacctggccccttaaaccttttctaataaaaggactgcccgtaagcccaacacagggagacatatttaagctggactcctgtctccttgttagttgacttacaataaaaagcttttcttaggccaggcacggtggcttatgcctgtaatcccagcatttggggaggctaaggcgggaggattgcttgaggccaggagtttgaggctgcactgagctatgttcacagcgctgtacttcagcctgggcaacacagcaagaccctgtctctgaaaagaaattaaaataagctttgcttttcttaaaaccccagtgtcctaatattgacttcaagcacattgggcagtgagcccctttttcttcgatagtgccaggtgtgaccccaccccttgttccatcccttcttcttatccttaatgagtgcttaattctttgctattagatttttattctgcatctcccatttgtttctcttaaaaagaaaaaatgtcattccatttaaatagacaggaaagtgaaatgtatcatgttacttttttggggtaggtgtctatttgtggtgtgtgttttcttctttgaaacttcttgacaatgttgggaaagaacaaattgaaactttcctattttcttaccacagtctgtgtaaggaagtcttcccatataacctctataaagagagagtgtggtgtcaattttaagatggcaaagccatttactgtgcaccttggtggcattttcattctatagcttccccagtggtgatgtgttctaaaaacaactgggcagttttctatttgtgaatcttaaattacacgtgtggtgtttatatgctcttacggtgaacttgatgttgaaaccaaattacatgctggcgaagggcactttggccatggccatatcccactgcaggaccctagatgatgggttactaaacaggctgacactgaaggatgacgtcacgttgagtgaatgtgctaagttaaaaccaccaaggccagctctcagaatagttctaacctcttgcccgtgactagctggctggttggttttgaaagccattctcaggagttcttacatcacaggctgcctttatttgtaaataattttcatcttgcattatacttggctattttgaggcaaattaatagtaactttttttttttctgaattggagtttcgctcttgttgccccggctggagtgcagtggcgccatctcggctcactgcaacctccacctcctgggttcaagcggttcttctgcctcagcctcccgagtagctggggttacaggcgcatgccaccacgcctggctaacttttgtattttttagtagagacagggtttcaccatgttggccaggccggtctcaaactcatgacctcaggtgatccacctgcctcagcctcccaaagttctgggattacaggcctgagctagcatgcccagcgaacagtaattttcttaagaaacggaatcagccacctggattcagtagtcttgtgaataccaacttcagagattaaaaggaaataggcggtattaaataccactttcgttttctaaattcataatgaaaagcatttggggaaaattgtgctaagaggatgataaatgcttccctagacttaatccaaatctacattttaacaagatcccctatgatatcatatgtacattaaggtgtaagaagcattgctctagagttaggcaaatactgtatccattcagcagctctgctataccttggctggcatctcttgattatcttcaccttttttttccttgtggtcacaggatggctgctgcagctccaaatatcacatctaggtcatagcttagaagaaagttgaagaggccggtggctctttctttgttcagaatcaaaagcttttccagcagctaccagcagacttccagtatatctcattgactacccctagctgctggagatgctgaaaatggggtgactgggaagggagaaatgttagaataatgaagttaagagaaagtttttgataaggtgtgcaactaggggatatccctatcgtatatatcctgaataaacttttgttctcttatacacagattctaggaaaaaaatgggggtgaatatagttctgtgtcaacattttagactcttaggagaattgtagtttaaaccattgtggaaatcaggaacactatatttttgatacttcatttgtaatataatggtgaccgttattgagaaaatttcctttgaatgagttatttgtatgaatctttgcaaattgcatggttttaattcagtgagtgtcactaataagaaattggtttcactgctttctatcatttcatattctaataatttgaaatggcttggtaaatgaggtagaaggataacgagctctaatgggtctataaatagaatgcagtgtgatttgtgaaaatacagaagccttatcttgtttttaaagatgaacttttatctaaagctagaattgttctcctttattaaagaccttcagatgagtggggcccttggaaggactcaagaatcccatttgcttatctctctttgatttaggggaactgtgtcaatctgacagaagcactgtcgctctatgaagaacagctggggcgcctgtattgtcctgtggaattttcaaaggagatcgtctgtgtcccttcatacttggaattgtatcctttgaccgtgacattctgttgccagatcaaagcacccaagtaaatcatatgccaatgaaaaaatttaaatcacaataataaacaattagcttagccatagagtatataaagccctggttctccagcttaggtgcacattggaatcccctgagaagctttaaataaaatctgagattctagacttccattctcaaaagttttggggtctggcttgccacagctttccaggtgcttttaatgatcaagcactactggtctaaagcattggttctcaaaggtgttgccagacctgcagcatcgctcaagaactagttagacatggacattctcaagccccaccccaacctgctgcccaatcagaggaattctggaggtgggggcccagtgacctgttctaccagccctcccagggatttatgtgcacctgaaaagtttgagaagccctagtctaaaataaccaccctacctgtggcaggtaaaatgtctaaagacactcattctactcttacattaaaataacctgacattaatactagtttctacacttgatgctaatttgcaacagaaatcgagaactagaatgatgttggggactgcacggttaacattggtgttctctgttagttccgcttagtaaagttagtctagagaagtaaaacacagaaagaaaaaaggaaatgagcattatcattggaaatttgtgccgcaacacagctgtgggctgtagtctgcagatgacggcttccttatctgctgttgccaagtccaggttcctgtgacggcagggtttttttgctgtcaagggagcaactgctgctgacctccagtgaggcctggtcccatcaggctggggcagagcccgacggggcaaactgcctgctgagaccagatggccagcaagaggcaatgagaaccctctagatcctccatgtgaggaggggagtactccgcctgctgggtggccgtgtccctccacagcctgtacagagcttcagcatctcctaccaactgtccacctttgtttagggttcccctcagcatttttgtcaggcctgtgtttgcatgttgggagatttgagaaatcagttgataacatttgaggcaaagtcttccacctgctagttcttctctctccctccttccttccctctcctttcctcctctgaccttttttccctctcctcctccttccctctcctcctcctgccctctcttccctcccccttctctcccttgtatctcccgctaccctaactttccctccctccctcctttcccccttccttcctttccttctcatactaattccctaaaacttgtgagactttggaagcagtagtgttacctgagagaatatttgtgttcctttagccttctgttgtctactcagtacctccttcagacctcccaggtggtgaggatgtccccaggctgcagagtggccttattcaaagtccttcgttctcattcccacagtgctctaagccatgaagcttttcatccatctttcaatttgtaggccagcaaacgaattacaagtgatgtcttttcttccttgaattacctgcttttattccttgactccctgtccaggtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagagacattttgtgtgttctgtcgttttatttcagcccagtcccctctttctgacttgtgatctcatagagcaacagtatctcctggtctgtttttagttctgtcactcgatgtcatttatctctttataataggatggccccggggccttttttgaacagtagtaatgacttcatttgccaccgtgctaaatgatacacaacctattacattcaccagtccttcattataccattgacctgaggctagcaagagattttgtctgactgtaaagttgaaagtcaaaagcttatttctggtcccactcttagcagtgtattagatgtggaaataaaagtcattttgggtagctgctatgaaactttctgagcagattcttggctgcaccgatgtatgacagaatttatggagaggcctatggcaatatgagcaacttgaaaactcctaaggaagtgcaggtagctaacagcttggtgtggtgtgtgtgggtaacaatccacatcaaaagtgagctttacattgacttggattgttagacatcagtgggttattctgttgtttttataaaaggtttatactgtatcaatggaatgagtcatttatgatgaatttgcaataagcaaagcattaaaaatgaaatattcagtgtccattttgaggtagaattggtgtcaacacagaacgttcttcctctcaaggtgtaggaatcaatagtatggtatttaaaaaaaaaaaaaaaaattttttttttgagacagcgtcttggtctgtcacccaggctggagcgtagtggcctgacattttttttcttaaatgagtgaatgtctactttttctttttctttctttcttttttttttttttttttttttttttgagacagtcttgctctgtcgcccaggctggagcatagtggtacaatctctgctcactgcaacctctgcctcccaggttcaagcaattctcctgcctcaggctcccgggtggctgggattacaggcgccggccaccatacccagctaatttttgtattttttagtagagacggggttttgccatattggccaagctggtcttgaactcctgacctcaggcgattggcccacgtcagcctcccaaagtgctaggattacaggtgtgagccaccacacccggccgcctactttttctttgtattagattgtcatggaagaagatgaagaagaaaggagttagtcatgttgtaattagatagacttaacttaaatttttcttgtgcacataggttaaaaatagcattagtagacattctccccatcccctccaactctactatagtgctttgcaaagctctgtgtactgtgtaagatataaaatgatggtactgttactgtagaacactgtttgggagtcaatagaattggatttttttctactttataaaagaaaccaggtatatgtacctgctgtctggatatcgtgtttttaataactgggcatgactttgtacttgaagactagcttgaggctggggcagcagatccactgataaatctgttgacacaagtcctgcaaagacctgagaggtggaaatgagtggatcaggttgtgccaggccatgggagatagattcaggagacagtaagggatgtggaataggaaagaaaggaatggaaatatctgtcttttcatttagggtgataatagtgaattttgacccaactcacttctttgtgttggagaaaggatgatgtatgttttgaacatctttgttactgttttaaaacaaaagcatgcaaactgaactctgaaaactgaaaatcccctctgcttttgctgacttttaaagaaatgttataagatctagcattgttgttttactttaatggctgtagtgttatatagtattacagtctcctttataacttaaactggaatatactgtagtatcctatagctgctttttaattagagacaagacaaatatgactgtttaaaattccatttaacacatcagcagatgtcaataatttatttaaaaagtgaaatgctgctttctcgtagaagtgtgattgattgaatattttagagacttgactaatggtgatccagcggggctagaggaaggctgggttgacagtgtttttaatgggctggagcagtgctgatgtcgaaataaaaatgtgctagtacttcctgtacagtctgcatagtcacttccttgcttgcattaactattgctgacgcaagactttgcatttctaccatctgtctcagtagatacatcaatttcattctggtcccatgactcctgggatagggtggggaattgtgggggtgtgggttttatgttaaatatcactggcctgtgttcaaggctctagagcaggaccagtcaaaagtgtagtttgtcaaccagctctttgttttctaagcgctgcacttcagctgacctgtttttcacagcaagactctcattgaaagaagcagtgtgctgatttttccccgtggcacaagctccttaccacatcttggagcagcatttttttgagaccgagttttactctgtcacccaggctggagtgcagtagcgcgatcttggctcactgcaacttccgctagagttcaagcaaatttctcgtgcctcagcttcccgagtagctgggattataggcgtgcgctaccacacctgactatttttttttatttttagtagatacggggtttcactatcttggccaggctggtctccaactcctggcctcaagtgatctgcccgccttagcctcccaaagtcctgggattacaggtgtcagccactacgtctggccttggagcagcaatatgagtactactcttccagaagccagttgggccgcattattgaatacctagttcatagataagagctgatatgtgaccttgaagaagtactctatctccttcaattaccttcttgccgcgtgtctttgtactaaatctttaaccttgctgttctttgggctaataaaccactttcatttacattatcctgctctgtcttaaaacagctttgtgaaggagatgttaataacactaggcaggctagcagtccaagtttgaaatgtgcctgagggtcccgtgaatccgggttccagcattcttaatttctaacatggatgcttccatcagaggtgcttaactgtttttgtaccttggactcattcagcagctgcctggtgaaacctgtgaactccttctcagaaacattttaaatacataaaataggattccaagaaacaagttaaattttccaaaaacttacgatagaatatttgtgctgctttatttgttacatagctagatcaagtggtgggtcacacaccataattgtgaagtagtaatacgcataagatctgtagcaactgaaatgtgatgaaaacacatttgatttgttgacaaagttacaggaactgctgtgtactaacgtggtttgtcacccgtgttcatgcttaaaggaaatgctaaatttcagtgggagttagtaaagataaagatagaaacattttcccatccaagtttatggggtcacagaattctgtccataggccccaggttaagaaatcctgacctacagtttttgcttccattgttttcattgtatttgagcggtgggggaagggtaggtgggatcccttcaccgttctgtcagaacctgaaatcaacactggcagatcagttctcctcagccagaaccatttaaaatctcaattacctcatgtagtcatcctactgatttctgctttactcattatttcaaaaatgaaaaatagaacatgggcaagaaatagcccagtgcttttggaaagctatttgaatcctcttggatgtgatttccctgggaaattggatgataaatgtgactggacaggtagacttagctcctgtatctgggggtcctgggatgctcaggccaactaattaatgcagacagttttcccatgtaccaaccaaccatgtgatcatttcagtgagcaatttttttatgatgaagcatcagggaatagacccttctctgtgcaactttgcacaggaatgtaaaaataagtgaattaggcagcctttctaggaaagaagcaggccaggtatattttaatggaaggcctccaatatccagagaagggagggttgggggttgctccaccccatttcctaaaaaagactggcaggaggtcagtctctgtagcccttggctttgaccatagagttacttattagagatcattcctagttccacctattagggaatacttttttcttgactttgttctaaaatagtcctaatcttggtaagtgattatgatggtagcttaggttcttgctgagtgattcagactgctcctgtctgttcattgctaagggacagaaacactccttggacttggtcacgcacacagctctacactacattccatgtcctcttatactttctagatgttctgtctttctccagtttaaatttggcacctgaaattccccctctgtccatcttcccaatgctaagggggagcttttgccaacatgtcccatgcattgcatgttcccttcagtgtttatattttataatcctcatcccatatctactgacgatgtatgtttactttttattattatactttaagttttagggtacatgtgcacaacctgcaggtttgatatataggtatacatgtaccatgttggtttgctgcacccatcaacttgtcatttacattagttattcctcttaatgctatccctcccccagtcccccacctcatgacaggccccagtgtgtgatgttccccgccctgtgtccaagtgttctcattgttcagttcccacctatgagtgagaacatggggtgttgggttttctgtctttgtgatagtttgctgagaatgatggtttccagcttcatccatgtccctacaaaggacatgaactcatcattttctatggctgcatagtattccatggtgtatatgtgccacattttattaatccagtctatcatcaatggacatttgggttggttccaagtcgttgctattgtaaatagtgccgcagtaaacatacgtgtgcatgtgtctttacagtagcatgatttataatcctttgggtatatacccagtaatgggattcctgggtcaaacagtatttccagttctagatccttgaggaatcgccacactgtattccacaatagttgaactaatttacactcttaccaacagtgtaaaagtattcctgtttctccatatactctccagcacctgttgtttcctgactttttaatgatcgccattctaattggcatgagatggtatctcattgtggttttgatttgcatttctctgatggccagtgatgatgagcattttttcatgtgtctgttggctgcatacatgtcttcttttgagaaatgtctgttcaaatcctttgcccaccttttgatgggcttgtttggttttttccttgtaaatttgtttgaattctttgtggattctggatattagccctttgtcagttgggtagattgcaaaaattttctcccattctgtaggttggctgttcactctgatggtagtttcttttgccgtgcagaagccctttagtttaattagatctcatttgtcttttttggcttttgttgccattgcttttggtgttttagacatgaagtccttgcccatgcctatgtcctgaatggtattgcctaggttttcttctagcgtttttatggttttaggtctaccatttaagtctttaatccatcttgaaataatttttgtatgagctgtaaggaagggatccagtttcaactttctacgtatggctagccagttttcccaacaccatttattaaatagggaatcttttccccattgcttgtttttggcaggtttgtcaaagatcaaatggttatagatgtgtgttattatttctgaggcctcttttctgttccattggtgtatatatctgttttggtaccagtaccatgctgttttggttactatagccttgtagtataatttgaagtcaggtagcgtggtgcctccagctttgttctttttgcttaggattgacttggcaatgcgggctcttttttggttccttatgagctttagttttttccaattctgtgaagaaagtcattggtagcttgatggggatggcattgaatctataaattaccttgggcagtatggccattttcacggtattgattcttcctacccatgagcatggaatgttcttccatttgtttgtatcctcttttatttcgttgagcagtggtttgtagttctccttgaagaggtccttcacatcccttctaagttggattcctaggtattttattctctttgtagcaattgtgaatgggagttcactcatgatttggctgtttgtctattattcgtgtgtaagaatgcttgtgatttttgcacattgattttgtgtcctgagactttgctgaagttgcttatcagcttaaggagattttgggctgagacgatggggttttctaaatatacaatcatgtcatctgcaaacagggacaatttgagttcttcttttcctaattgaataccctttatttctttctcttgcctgattgccctggccagaacttctaacactatgttgaataggagtggtgagagagaggcatccctgtcttgtgccagttttcaaagggaatgcttccagtttttggccattcagtatgatattggctgtgggtttgtcataaatagctcttattattttgagatatttcgcatcaatacctggttgattgagagcttttagcatgaagggctgttgaattttgtcaaaggccttttctgtatctattgagataatcgtgatttttgtcgttggttctgtttatgtgatggattacatttattgatttgcgtgtgttgaaccagccttgcatcccagggatgaagcccacttgatggtggtggataagctttttgatgtgctgctggtttcagtttgccagtattttattgaggatttttgcatcaatgttcatcagggatattggtctaaaattctcttttttttgttgtgtctctgccaggctttggtatcaggatgatgctggcctcctaaaatgagttagagaggattccctctttttctgttgtttggaatagtttcagaaggaatggtaccaactcctctttgtacctctggtagaattcagctgtgagtccgtctggtcctggactttttttggttggtaggctattaattattgcctgaatttcagagcctgttattggtctattcagagattcaacttcttcctggtttagtcttgggagggtgtatgtgtccaggaatttatcgatttcctctagattttctagtttatttgcatagaggtgtttatagtattttctgatggtagtttgtatttctgtgggatcggtggtgatatcccctttatcattttttattgcgtctatttgattcttctctcttttcttctttattagtcttgctagcagtctatcaattttgttgatcctttcaaaaaaccagctcctggattcattggtttgttttttttttttgaaggattttttgtgtctctatttccttcagttctgctctgattttagttatttcttgccttctgctagcttttgaatttgtttgctcttacttctttagttattttaattgtgatgttagggtgttgattttagatctttcctgctttcttttgtgggcatttagtgctataaatttccctccacactgctttaaatgtgtcccatagattctggtgtgttgtgtctttgttctcattggtttcaaagaacatctttatttctgccttcattttgttatttactcagtagtcattcaggagcaggttattcagtttccatgtagttgagtggttttgagtgagtttcttaatcctgagttctaatttgattgcactgtagtctgagagatagtttgctgtgatttccattctttcacatttgctgaggagtgctttacttccaactatttggtcagttttggaataagtgcgatgtggtgctgagaagaacgtatattctgttgatttggggtggagagttctgtagatgtctattaggtctgcttggtgcagagctgagttcaagtcctggatatccttgttaaccttctgtctcattgatctgtctaatattggcagtggggtgttaaagcctcccattattattgtgcgggggtctaagtctctttgtaggtctctaaggacttgctttatgaatctgggtgctcctgtactgggtgcatatatatttaggatagttagctcttcttgttgaatttatccctgtaccattatgtaatggccttctttgtctcttttgatctttgttggtttaaagtctgttttatcagagactaggattgcaacccctgccttttttttgttttccatttgcttggtagatcttcctccatccctttattttgagcctacgtgtatctctgcacatgagatgggtctcctgagtacagcacactgatgggtcttgactctttatccaatttgccagtctgtgtcttttaattggggcatttagcccatttatatttaaggttaatattgttatgtgtgaatttgatcccgtcattatgatgttagctggttattttgcccattagttgatgcagtttcttcctagcagcgatcgtcttaacaatttggcgtgtttttgcagtggctggtaccagttgttcttttccatgtttagtgcttccttcaggagctcttgtaagacagccttggtggtgacaaaatctctcaggatttgctcatctgtaaaggattttatttctccttcacttacgaagcttattttggctggatatgaaattctggtttgaaaattcttttctttaagaatgttgaatattggcccccactctcttctggcttgtagggtttctgctgagatacccgctgttagtctgatgggcttccttttgtgggtaacccgacctttctctctggctgcccttaacattttttccttcatttcaaccttggtgaatctgacagttgtgtttcttggggttgctcttcttgaggagtatctttgtggtgttctctgtatttcctgaatttgaatgttggcctgccttgctaggttggggaagttctcctagataatatcctgcagagtgttttccaacttggttccattctccctgtcactttcaggtacacctatcaaacctagatttggtcttttcccatagtcccatatttcttggaagctttgtttatttctttttactctgttttctctaaccttgtcttctcgctttatttcattcatttgatcttcaatcactgataccctttcttccacttgatcgaatcagctattgaagcttgtgcatgcatcacgaagttcctgtgccatggttttcagctccatcaggtcatttaaggtcttctctacactgtttattctagttagccattcgtctaaccatttttcatggtttttagcttccttgtgatcggtttgaacatgttcctttagctcggagaagtttgtaattaccgaccttctgaagtctatgtctgtcggctcgtcaaagttgttctccgtccagctttgttctgttgctggcaaggagctgcgatcctttggaggagaagaggtgctctgggttttagagttttcagtttttctcctctgatttctccccatccttgtggttttatctacctttggtctttgatgttggtgacctacagatggggtattggtgtagacgtccttcatgttgatgatggtgctattcctttctgtttgttagttttccttctaagagtcaggttcctcagctgcaggtctgttggagtttgctggaggtccactccagaccctgtttgcctgggtatcaccagtggaggctgcagaacagcaaatattgctgcctgttccttcttctggaagctttgtcctagaggggcacctgcctatatgaggtgtctgtaggcccgtactgggagctgtctccctgttaggctatacgggggtcagggatccacttgaggcagtctgtctgttttcagagctcaaacgctgtgctgggggaacaactgctctcttcagagctgtcagacagggacgtttaaatctgcgaaagctgtctgctgctgttcagctatgccctgcccacagaggtggagtctatagaagcagtaggccttgctgagctgtggtgggctccacccagtttgagcttcctgggctgctttgtttacctactcaagcttcagcaatggtggacacccgtcccccagccaggctgctgcctcgcagttctatctcagactgctgcgctagcagtgagcaaggctccgtgagtgtggggcccaccgagccaggcatgggagagtatctccttgtctgctggttgctaagaccttgggaacagcacagtatttgggtgggagtgtccactttttccaggtacagtctgtcctggcttcccttggctaggaaagggaaatcctccgacccctggtgcttcccgagtgaggtgatgccccaccctgcttcggcttgccctccttgggctgcacccactgtccaaccagtcccagtgagatgaaccaggtacctcagttggaaatgcagaaatcacctgtcttctgcatcagtcacgctgggagctgcacaccagagctgttcctatttggccatcttggaacagaagagcgtatgtttaattttttaatgtctgaagaagatggtgtgccttgggaagaatacagacacctgggtttgggttctgacagccacttaagaactggaggtttttaacttaagtgtagtgagggcaggagcagcaagaacttcagcccaagtccagctggcatgagctaaaatggaagctctgaaagccactgggtccttcttttgcctttgatgcttcatgcatgtagtaggcacttagtcagtatttccaaccttgggagattgaagcgtaccgtaaaagggaattcttagaattgcattttccatgtaggacatggaggaaacaggttggctggaagaagttacccatagctgggcttgctgaagaagaaaagcagtctgtgatgataaagggagaagtccccgcaaattcattttgctcaaaggagcaaaaatgtgtacttgacactagcaaaggtgcagtcccagtaatggtgaaagtgctgtgttggcgaaaggggtcctcaaagtccagctccttcctggttctcctaagggctgaagaggagcagaaactagaagatgtacagtggtcagactggaaaatggaaaaagtggaggatctgtagccattttgactgtcagccatttctgtgactgagtcttctctcttttctccttgtttgatcttcactgacctgagtcttgaatatctttattccccacccatttggatggagtttctgcaccaggcctccactttgatccgggccagcccacagaggactgtctttggctcaggtgccgacaccattctgcagaggccagggttcaaggccacacaactctgattttggttgcctgtgtttagtttgagcctggcccttggctctcacttgatgaatctactaaggatttgtgcatcaaaataattaggcatagtgatgaattataaacgttttaaaaattggaaatcatggccgggcacggtagctcacgcctgtaatcccagcactttgggaggccaaggcgggcagatcatgagttcaggagattgagaccatcctggctatcacagtgaaaccccctctctactaaaaatacaaaaaattcgccaggcatggtggtgggtgcctgtaatcccagctactcaggaggctgaggcaggagaattgcttgaacccaggaggcggaggttgcagtgagccgagatcgcgccactgcactccagcctgggcaacagaacgagactctgtctaaaaaaaaaaaaaaaaatcatgagtatgtatggataataagtaggacacaaagggggctcttttttactgtttagtggcaagtggttatgggagagggagtgctgaaattgaaaaactagtatttgataatcataatgaaggctgaatcaggcaagaatcatccattggtgttagatcttaagggaaatctcagcaaggatcatatttacatggctttaaagtatctcccatagattgcttatgagttgtgtatcagttccctattgcccctttaacaaattaccaaaaacttatttccttaaaataacacagatttctcttacagttctggagagtcagaagttcaaaatgcgccttagagggctaaaatgaaggtgttggcagggttggttccttctggaggctcctgggaaaatctgtgttctttctttaatttcagtctcaaagccagcagtggaacagtttcaagtctctctgctcctgttgtcacattgccttccatctctgtctcctgtgtccctcttgtaaggccacttgtgattacaagtcctacctagatgatccaggattctcttcctgcttcgaaatccttaaccagttcttcaaaatccttttgccatataaagtaacattcttataaggctctggagattacatggggtggggcggggtggcagggtgggggcatttatttcacctactgcatgttgcaagataaaagtaactttacagtgcagaaattggacaacatcttgaccaggtaatgaaaatcaacatccacaagggcaggtggacgtcctgtgcctccagaggtgacactctgagaagggtctgtcaccacctatgcagtatttggcttaggatccattacctgaatcaaatcatgaaacctgagatccccaaaggaagaatgttctattaagaaagaggcctggtacaaaagtattaatgtcaaaaaagacaaaggctgtgaaaagattccagattaaaggaggctaaagagacatggcaactaaatgtaatacctgaccctatcctagatactgtattggaggaaaaaaaatgctgtaaaggacattgtcagttgacaagttagaatgtagtttaatacaaatattgtatcctatttattgaagttcttattgcaaccctgagcttgaagttatttccaagtaaaatgttaaacattttaaaatagggggaggaattcttttggcacagtttatctcccatctgcctgagggccatgctagcaagacttctggacacagaattgaagacctaagagcaataaggctccagggacccgcgtaacacccaaaggagcattcttctgctttacagtgtagcccaggaggcagtaaggtggcaagctcctcaggcagcagaagtcctagtggttaaattatgtctttgaggctttctgtctgctacgcaagaaaccaaagctgcatgggctcccaccagagactacggaagccagaggagcagggtctgcccatgatgtctgcagtaggagaaacaaaaaagggagatatgagcaagaggatggtgtggcagctggctgtacagccgcactccagtcctgctggcttagaaataaaaggccccagggaaagaacctgctttaaagacttcctgagcccgagctgctgctaagacactgcagacgttgaagagttttctttttttttttctttccctgatgtgtgtggcagaagggagggatgagagtgggttcaaagacttgaattaaggcaaagagccccacattgtaatatttcagatttgaaaataggatctgattaaaaaggttgtccaattagttttacaaggaaagtgaccgaggacttcaagaggttctgttggaacagtagttatcctgctttctagaagtaggacttggccgggcatggtggctcaggcctgtaatcccagcactttgggaggccgaggcgggcagatcacttgaggtcaggagttcgagaccagcctgaccaacatggtgaaacgctatctctactcaaaatacaaaaaaattagccaggcctggtggtgggtgcctgtaatcccagctactcaggaggctgaggcaagagaatcacttgaacccgggagacagaggttgcagtgagccgagatcacgccactgcactctagcctgggcaacagagtgagactctgtctcaaaaaaaaaaaaaatagaagtaggactagaaaaactagggcagtgcttctgaaacttgagtgcacgtgaaaatcacgtgaggatcttgttaaaacagtctgattcagtagttcgggagtagggcccaagaggcagcatttctcacagtctaattagtagatgttgatgctgccagtatgtggaccacactttttgagtattactgagctagagtaatggtcaaatggaaaattggatgggtcacattgcagaaaaatgaagacagctgttgcatgaaccactgcttaatttaaatgtaaatatcaatgtactgctctaagtggccgtgaaagcaataggtgttgccatagtaattgctaaaatgtgtgtctgatttccaagggttggaaattttctcatgtatatgattaaaaagccaatttgataccacccaaagcaatgtatagattcaatccaatcactaccaaaataccaatgacattctcaacagaaataggaaaaacgatcctaaaatgtatatggaaccacaaaggaccccaaatagtcaaagcaatcctgagcaaaaagaacaaagctggaggcatcatactactggacttcaaaatatactacaaagctgtagtagccaaaacagcatggtactgacataaaaacagacatcaaccagtggaacagaatagagaacccagatggccgggcacagtggctcatgcctgtaatcccagcactttgggaggctgaggcaggcggatcacgaggtcaggagatcgagaccatcctggctaacacggtgaaaccccatttctattgaaaatacaaaaacttagccggacgcggtggcgggtgcctgtagtcccagctactcgggaggctgaggcaggagaatggcgtgaacccaggaggcggagcttgcagtgagccgagatcgtgccactgcactccagcctgggcgaaagagcaagactccgtctcaaaaaaaaaaaaaaaaagagaacccagatatacatccacacaccgcgaactcattttcaaccaaggtcccaagaacatgcaatagggaaaggacagtctcttcaatacatggtgctgggaaaactggataaacatacgcaaaagaatgaaagtagaccccatctccaaatcaaatcaaaatgggttacagacttaagtataagatctgaaactatggaacatctagaagaaaacgttggggaaatggtcaggatgttggtctgggcaaagattttttgtgtaagacctcaaaagcacaggcaactgaagcaaaaatagagaaaagggattacatcaaactaaaaagcttcacagcaaaggaaacagaaaagagacaacccacagaatgggagaatatatttgcaaactaatgatctgacaaggggtggataactagactatataaggggctcgaacaactcagcaaaaaaatccattcaaaagtgggcaaaggacatatcctcaaaagaagacatacagatggccaataggcatatgaaaaaatgctcactagcactaatcatcagagaaatgcaaatcaaaaccacaatgagatatcatctcaccctagttaaaatggctcttataaaaaagggaataatgggtgctggtgaggatgtggagaaggggaaccctcctatgctgttggtgggaatgtaaattacaacagctgcaatggaaaagtatggaggttcctcaaaaaactatagatatatctatatagatataccatacatctatatatatatcatacatctatatctatatagatatatatctctatatagatataccatacatctatatctatatctgtatctactccctatctccaagagatctacctttttagctcccactttgatacttctcttactgtgcttggcatgtttcatttaacgtgacctccatttccatccacatttctgcaaatgacaggatttcctttttatggctgaataatattccatactatataatacatatagatatagatgtatggtatatctatatagatatatagtatatatccaaaagtaaggaaataagtatatttaagagagatttgcactcccatgtttattgcagcactattcacagtagccaaaatacggaatcaacccaagtgtccatcaatagatgagtggattaaatgaatttgtacacagtggaatgttattcagccataaaaaggaaatcctgtcatttgcagaaatgtggatggaactggaggtcacgttaaatgaaacatgcagagcacagtaagagaagtatcaaagtgggagctaaaaaggtagatctcttggagatagggagtagattggtggttattggaggccaggaagggtgacgggaggggatggagagaggttgattaatgggtacaaatatacagtgtgatagaagaaatgaaacctagtgtttgatcagtagggtgtctggtttataattactgtatatttcaaaatagaagaaaatagttctaatgtttctagcataaataaaagataaatattaaggtgatgggtataccagtgacagtgatttgatctttacaagtcatatggacttacgaaattatcacatgtacccccaaaatatattatgtatcaataaaaataagcactaaagaaaggtaatttgataaaccattaatctggggcttctttttaagctctccccaaaaggcatggagacccccagcccttgaaagattacaaaacagtgctggtggatagaggcccattaggagagactttgaagcaacaagcagtgcaaaaatgatcaaggattctgaaagggtatggattgttcatttgcagacactgccctgacagctagaaggttctaaacacaaggataagggattataccctttattcacctaagcatgcaacttactgaagtctggattgtgctttgatttcatggctttaggtaagtttatttctgtggagagtaaaactggaacaaacttcactttgtgcttgcgtcttttgcaagtttattgaaaatacaaagaataataaggggaagaattagaggttatatgattctgtcctgatgctgtactagaacagcttttggcagcgcttatagaccacttttgctgtagcctctgtgtaaagggtcatagacaacgtgtgggatatatccacggcaatgtgtagaggaaagaacacgtgggcagcctctttagcagcaaagaaaaataaaagccacagggcactaggagggctgctggaaacagaagcatgaaggggaagttaagactttataaggtgaaggctgtaaagaaagtgcacaagttttaggttaagggagggcagggctggaggtgatttattacaagtactttataaaacactgaacgtttagaagacactgcaaagcctaatactatttagccctgctatagctatataaaaaataaactcttaggtttctccataaccaaaaagccatcaggcccttccaatcttattccctcccctaactccccaagctagaaagatatctgggctggtgttagagattgaattgtcttcctcaaaaagacgttgaagtcccaatccccagtacctatgaatgtgaccttatttggaaatagggtctgtgcagatggtaagatggggtccttaggttgagaccttatccaatgactgatgtccttatattaatggcaaaacagcagttacttttgcaccaacctgataaaggaaatttggacacagagacatgtgcagagggaagatgatatgaagacaccgggagaataccatctacaagccaaagaacagctgaggctaccagaagctaggagagagggatgaaactgagtctccctcacagccctcataagaaaccaaccttgctgatgccttcatctgggacttcctagcctttagaactgagacaatttctgttgtttaagccacccagtttatggtactttgttacagcatcaccaggaaactagttcaaatggtctacagaataattagacagcagatggaggaaggtttgtgtatcagtcagctgtcactgcgataataccgcatagcaagcaaacttgaaatgtcaacagcttcaagcaacaagtgttgatttttctcctcagccatctgcaggttggctgggggttcagctgatctaggctgggccctatttcaaactgtgttaggtccacgtttgctccacatgtctctcatcatccttggatcgttggctacctgagacgtgttctcacagcaaaaggcacggagcacaagaggacgggcacaatgacacaagcacatgtcaagcctctgtgtgtgccatgtctgtcagtattccattggccatagcacaccgcatagccaaacccagggcgaagagaccgggcagtaccctttgccaatcatgaggcaaggagatggatgataggggagtgaataattggcaaagagatttcaatctaccccatttgactcctgaatttattgtaagaggccaggagttcaagactagcctggccagatggtgaaatcccatctctactaaaagtgtagaaattagccaggcgggttggagcactcctgtaatcccggctacttgggaggatgaggcatgagaatcacttgaacccaggaagcagagagtgcagtgagctgagatcccgccactgcactccagcctgggagacagagtgagactccgtctcaaaaaaaaaaaaaaaaaaaggtgttttaggaactaggaaagttcctttctcagggatagcagcagtctagcttgactctgacaaacgtggtgaagactaaatcctatagcctggtatcacactttaagtgaagcattcaacagatgaccttttattagcaaagatgttaaaacctttgcaggaaataaccaaaagcactaatgggcatcttatatgtaaaataatactgtgaagtgcacagacatcctacattgtatgagatgctaacatttgtggtttcctggaaagaacattgttctgaaaaatgaggaaaggtgccctctggtgaacatattcttttggtagttagagaacctgaaacacaggctaaattgtattccatcctttgacatgaaagttgagagttacaaggcagtgttgttccttctctccactccttgcttttagtagtagaatcaagacccacttgagaaatcatcctaaatttccaggactaaaagtcaatagtgttgtctctttactctgttgtttttttggttttctgtgtgtgtgtgtgtgtgtgtgtgtgtgtgtgtgtgtgtattgagatggagtttcactcttgttgcccaggctggagtacaatggcatcatctcggctcactgcaacctccacctcccgggtttaagtggttctcctgactcagtctcccaagtaactggctaattttgtatttttagtagagatggggtttcactatgttggtcaggctgatctcgaactcctgcccacaggtgatccacccgcctcggcctcccaaagtgatgggattacaggcgtgagcctccatgtccggccaagtatcaggtttcaaaagttagtgggcaagctcagaatttataccagcgcagccagtctgcctactatgttgtgccactgctgcctttaaaagaaatcagaggccaggcgcggtagctcacgcctgtaatcccagcactctgggaggccgaggtgggcagatcacgaggtcaggagttcgagaccagcctggccaatatagtgaatccccgtctcaactaaaaatacaaaaaattagccaggcatagtggtgcacacctgtagtcccagttactcaggaggctgaggcaggagaatctcttgaacctgggaggcggaggttgcggtgagccgagatcaggccactgcactccagcctgggcaacagagtgagactctgtctcaaaaaaaaaaaaaaaaaatcagatggcagaatctggaaaaatattaatggccacacctgctttagtatttacatttacaaaaaacaattgtacaaaactggtttcatttttaagacctattactttaatttccccaaatgctcaatttttccctccagtttctccatgtgtctccaagttcactgggtatgttagatgataattaaatgagggcagtaaagatgttagatgtcctcgatgtatcctggaaggactcatttaagggaggatagggtgatcttccatttgtatgttaaaaagggttaaggttagatatttactttaagtagctctgtaagctctggaagtcacagggcccatgccctgttgagctttgcaccccagggttgggcaggcacacgggacccaataaaaagaaaatgaaaatataaacaatcaaagagatgaggccgggtgcagtggctcatgcctctaatctcagcactttgggaagccgaggcgggtggatcaccggaggttggagctcgagaccagactggtcaacagggtgaaaccctgtctctactaaaaatacaaaattagctgggcgtggtggcaggtgcctgtaatcccagctgctcaggaagctgaggcatgacatatctggtggtttggctgtggaagacccagtaacatgccaaggacttaacaggggattcaacataacagtaatagtagttactaatttatgtttcaacttggcacagatacatggagaaagaaatccacgtgaaagagatgatcagccatctctttcatggaacaaatgcatttaactaggcctgaattcacaggccttcaaaatttgtaagactgatgtcaatatcctcatggaagaatcagaacaccacaataatgttactaggaaaaagacgtggagaagttggaaaatattcacattactatagggttttgttgtgtgccaaagagctcctttaaaacatgggaccagccactgaagtcactgcatgtgaagggctaaaaaaccaaaactgttagaaattataaagatacttggcaaaatttatcagaggtgacctacacttgtgcccttttcctgtattaccacccagtgcttggctcctggatttgaaatttgtaattcctgcacattcattttaaaaaaagaaaaccacagttcttccagtaccttccatcttcccacatgtctgcatctccaggcttcaaatttattatatgttgttaaattgcttttcaaaacggtgtaccaatttacacttatgattagggttatgagggttgaaagtgctccattgccaattgacattgtagacttttaaattttttgccagtctctgccgggtgcagtggctcacgcctgtaatcccagcactttgggaggctgaggaaggaggattgcttagctcaggagttcaaaaccagcttgggtaacatggcaaaactccatctctaccaaatatacagaaattagccgggcgtgggggcgggcgcctgtaatcccaactactcaggaggctgaggcatgagaattgcttgaacccatgaggtggaggttgcagtgagccgagattggagattgtaccactacactccagcctgggtgacagagcaagacaatcaatcaatcaatcaatcaatcaatttttgccagtctggagatgtgaaatggtcatttcttgtagtttaaattttcatttacctgagtattaatgaggctgggcatatttttgtaagttaattggccagtgttcctctttggaaaaatgcctgcctttttgtccatttggctattgggctttgattttcttattgatcagttgtactttaaatcttcaggataataatccattgttgcttgtatttttgttaaaagtgtctactctcagtctgtagtgtgtctttttcatttttagtagtgtttttggatgcacagaagttttttattttgatgtagtcaaatttgtcagtctgtttcctttatgatatgtgtttgtgtcttgttttagaaacctttccctaacctgattttctgtatatcttccagtgttttaaacttttgcttctcataatgagggctgtcatttgtctggtattccttttggcggggggggggcttttaaaagaaggtagctgaaagtagaagagaaaaaaggcagtagctgccatattgcattgatcacttgttgcaaccccattcaaaatgattcccttttaagtatttccagaatctgatgtattttcacttcacctctaaaaaaataatcaagactccgtctcaaaaacaaaacaaaaccgaacaaccttggattaagtgcagtgttgtaccatttttcaaaacatagccagagctagtgtcctgatgattagaatatgttattaaaacaaaatgcattttaaaaaaacaacattttcacaagggcatgccttggcggtcttgtctttgccactaaatgctgggagttctttgtatgtctttccctacccagtgggatttggatggaattatccaggatcttatagctggactttctgattctcagatttcaaaatttataaaggtaacacacgggttaattcacttccatggagaatggactccgatattgttttttcttttctttttttttttttttttttttttgagatggagtctggttctgtggcccaggctggagtgcagtggcgtgatctcagctcactgcagcctccgtcttttgggttcaagtgattctcctgcctcagcctcccgagtacctgggtttacaggcatgtgccactgtgcctggctagtttttgtatttttagtagagacagggtttcaccatgttaggcaggctggtctcgaactcctgacctcaggtgatctgccctccccagcctcccaaagtgctggattacaggcataagccaccgcgcccggcctacaactcctgatattcttcatgccagaataactctcaatgttacatagttcctgaggacaataaggtgatcatttatttatttaatacattatgggcacttactatatttcaggctctggcatgggtaagtgaagcaagatgacaaaaggcccttaagaatgtcccccagtctaaggagactaactcacaggcataaaacagtgggctgctgtctcctgatgctgcgtggtgtgccccatggacatttgaaacaatacaagtaaccatgtaaaatggccaaaaaagggctgggtgtggcagctcatgcctgtaatcccagcactttgggaggcagaggcaggaggatcgctagagcccaggggtttgagaccagcctgggtaacatagtgagacccccatctctacaaaatatcaaaaaatgacctgggtgtagtggcgcatacctgtagtttcagctactcaggaggctgaagcaagaggattgcttgagtctgggaggtcaaggctgcaatgagccatgattgcgccactgcactccagcctgggtgacagagtgagaccctgtctcaaaataaaatggccaaaaagggacagaggaaggagagcgtgagtgcttttaagcactcgaacggaaactctgatggttaggtggaagatacagtcaagggatagctgtatatttcccatgtttcttttttcctttttaaattcatcatccttttagatagaaatgtttaggggaaacagcagggaagggctgccaggaacatagcaatttggtttaccaagatcattatatttagtactttaatgtctagcttttgaggtgggggtgaggggtgttggatttaagaaaaagtaaacagttgttcttaattataccatactatgagacttggtgtgctagcttcaaacaaaataatacagtcttttcaccattacaggaacatcagtgactaaacagaatcgatcatctgggtggttatgattggaagttattgcagttaaataatgctaagtctttgagacaagcagtaaactccaaatggaattcatggctaatatcagtgaggcagtctactgtgtaatgtagtatttatcacctcctttggaagacgaatgatcttttcggtttgcataatgtattacatttttgaaattcatatatcatctgtgttttatataataataatacaataaaacgttcctagaatgtgacatgttgaaaaacattgtctccttaaacaaatgaacatgtgtatattatttaagaacccataactgaggtattttcctttttgctttaactgtcaaggccctcatttgcagtgggtaactcatcctcactctcttttcacctaagatctgtatttctctgctttaaaaaaattcttataatttaaatctatttgagtattttcagtgggaaaggatttaatatcgtaagctacgggataaggagctacagttttgcccttagctctgggcaacagggaccctgctctgggtcctggcttcaagagggctccactctggctatcctggggctatgcccttcaccatggagtgaaggatctgcagtgccaaggggatgtgcctgtgtccctttctaaaacacagtttttatctctgagactactaatgttctgtttaaacttgctcagagctcacatccagggcccatgggggtctccttctcagcttgtcatcccatcctcctgagggaagactgtgcctgggctcccatgtgttgtcaaggtgctgctgggatgggggatgtgaaaagagaaaggggatgggccaaggactggggcccgctctccaacgcgtttctatctgaaactcccaggagtctgagaattctgaattggaatcaggccttccaggtgggtatgaagtatatttccaaggtaggaggagggaatgtatttgattgaacagtttgtagcctgatttacagctttaaatggtatgtggctgcccctccatcttcgctcatgggtactcttcgctcagacccatgtagtgatgagcatggggacctatattatagtttttttagaaatagggacaatgagtattcattaagctatgtttggaagaataatggcaaatttattatgtcaaacaagctcttttagagttgaggtctttcaaatgcattataaaactgaaaataatcagtaaaaatttgaaaatcgtatcttagtttccatcccccatttgtaaatgatgccctattttatgtccatccatccattttttttcttttccactgagtattctattggcagaaagttctagagaagtgagatatgttttgatttgaataaagtcaggcttggtgaactcagagaatacttgatatcaaggaattcgatagtaagttttaaggcaacccatcagaggagatgtgaaccacactcggtaaccactatcttgatcatccttgaccatgactagtaactacagagtctgttattgctcctctcttttccttactcttcgttctggctacacaaatcacatactgaacccagccttttcaggctgacttcggtaatctcattgtgatttcagttgcattcatcctgcaaggttaaatgccttctcggtcaggtcccagaggtataaagctgtccaaatcgtggtcccaaccaccaggtggctgaaagactggacacctgctgtccttactaccaataggaacacaaccaactagggttagaggttgaccagggtctgcagtgaagagcaagagaccaaaggagaggtgatgtttcctttccattcccttccctcccctccgctcccctccccttccctctcctcccctctcctctcctttcctttcctgacacagtctcactttgtcacccaggccagagtgcagtggcgtgatcttggctcatcccaatctccacctcccaggctcaagcaattctcctgcttcagcctcccgaataactggaattacaggtgcgtgccactattgcccagctaatttttgtatttttagtggagatggggtttcaccatgttggccaggctggtctcgaactccagatctcaaatgatccacccacctcggcctcccaaagctgatgttttcttaaattgtggtaaaaaacacttcccttccctacctcttctctcctcttctccccccaactcctctcttctcccatcccctctcctttcatttcctcttctttccattatttcttcatccctccctcttttcctcccccagtaagtctggactgaatacctcccataggcatagacagccccaaataagaattttaaaacacaaacaatggagacatctataaggcatatctatgggtggcaaacatgaaatattaagaaacagaataataataatgcctgccacttcatcagaaaccattttaagcacttcataactattataatcatagtttattattatctcccattgccagatgacaaaattgagaccctgagagattaggcaattttttcaaggtcacatagcagtaagtagcaatgccaggaatccaatccagggagtttgttcccaaataccaggtatttaaccactgtcacactgcactatcctgcctggcagcgtggaaacatgtatcaacgtgaatcaacgtatatcaacgtgaatggtgcagttagcagttacaagaaaaagagaagggagctctgttagtgttatgtgaggaaagcagaaaccactctaggtatttcaaacaagtgtatttaatgtagggaattggtttcaaaggtagtggaaaggcagaaggaacaaaggagaggatgttacccagagttcagtgactgcaaaaggccgctactgcccttaagactagagaagcaaacagggaaaaggaatgtggcctaaagtccacatcacactcacctcggaggctgctgctgctactgctgagtgggactctaggagccacaatcccattgatgctgccagagtctgcagtcatctgcagccatgtgcccctgcagctgtcacatttgcggtctttatgtaggatcccggagtttcctcctgtggccctggataaacccaggatcagtaaagaaaaaataaaccaggcttctacattcctcctgtttttgaatttcctattaatgccttcccttgacagagtctaacaggaactcagctggcaagggagcctggaaaatgtagttcgtgggcttccagctgccaaccatacactgaacacactagaagatcacagtggggctgaaagccaaagcgtattctacatgctcagtgttgcataagaaaacgtggatacagggaagaaaaaaacatttaaccgaatctaagattcaatcgattgtaagattgtaagatgtatcataataccaccataataataccatcgagaaagaaaaataccgtcaaattatgccacatcaccacttacgaggtacattctacttctagaaatgttaaagcttgaaaaaaagtccctgttaaaattgataagatacagtaaatgtctgatctcaacttacatgtagtctaatggggcagacttctgcagagactattgtaatacaacctgacatcctgtgaccctgtgaccttactaagaagaggggtctgggaagattttctcgaggaggtaaaatctgagctgagtcttaaaagatgagcccgagtttcctaaagaaatggttttccaggcaaaaggagaaatgttttctttttttttttaattttttttttttgagatggagtctcgctctgacgcccaggctggagtgtagtggcgcaatcttggctcactgccagctccgcctcccgggttcacgccattctcctgcctcagcctcccgagtagctgggactacaggtgcccgccaccacgcccggctaattttttgtatttttagtagagacggggtttcacggtgttttccaggatggtctctatctcctgacctcgtgatccgcccgtctcggcctcccaaagtgctgggattagaggcctgagccaccacgcccggccgagaaatattttcaaagcgcaaaaggctgggtaaagtttagtgcatttgagaacttgaaggggtttagaatgactggtgtgtagggtgtaaattgagaagccgtgcacaggtgagcctggaggattgcgtgggctcaatcatgcaggaactcaatgtgaagtatttttacattttcctaaaaactgacagcagccactgaaggattttaagaacatcaaaagtccatttgaaatttgactcaggactgcaatttagttggttcataccagtgtggctgctgctgttgtgaaatagtgaaatatctccttactagctgtggatggctgcccctctggaccccctgcagcctcctccaatccaccccctctcctagaaccctccagatccagcaactaagatagtacagtaggggccaccgaaactggccccagtcccctggtcagtgccatgccatggtggttgttaaatattttgaatggcatcactgttttcactacataagtttaatgtttagttttgttggttcttcagtccactttaccacattgcagagagatttaatggttgccctacaccagtggttcttacaatgtggtccccagactagcagcatcagcatctcccaagagctggttagaaattaaaatttcaggccgggtgcagtggctcacgcctgtaatcccagcactttgggaggccgaagcaggtggatcaccagaggtcaggagttcaagaccaacctggccaacatggtgaaaccccgtctctcctaaaaatacaaaaattacccagacgtgatggtgggcgcctgtaatcacagctacttgggaggctgaggaaagagaatcgcttgaacccaggaggcagaggttgcagtgagccgagattgtggcactgcactccagcctgggtgacagagcaagactccgtctcaaaaaataaataaataaaaaataaaaagaaatttaaatttcagctcatctcagacctacagaatcagaaactgtagggatggagcctagcaatctgttttttaatttaatttaattttgagacagggtctcattctgtcacccaggctggagtgcagtggcacaatcaaggctcactgcagcctcgacctcccgggctcaggcagtcctcccacctcagcctcctgagcagctgggactacaggagctcaccaccacacccagctagtttttgtattttttgtagagatggggcttcatcatgttgcttaggctggtctcaaactcttggtctcaagccatctacctgcctcggcctcccagagtgctaggattacaggtgtgagccaccatgcctggccacaatctgtgttttaaccagccctccgggagattctggtgcccactcaaatttgagacctgcttctctaagccccttgtcctcataaacatctaggtaagccatccttgaacaattggttgttattaatcaagggcatacaaacttctataggttaatagtctaaccaaggagtagggtgagtgtgaccagtttgaggatacagcaagtaaacgctagttggatgaatagttatttcattttaaaattgttatgcagtggagtgctttggaaaaggtattaatattgtgggtttgggagctgtatcaatcatgttttttattttctatattttatgatgtgttgacatcttggtgccttgcagacccagggaaggtctgtccctcccagggttagctaattcctagagatagtaactgacttgcctgtgagcatgcctttgatatgcaaatcaaccaatccacgttcatataccccccacttccttttaccagactcctgcagtcaaggacactatacccctacctttccaccctaaatcatcccagggctaggtacgagagtgctagagaccacctctagggaccagagcctgctgaaattattgatgctatccacccaatcctaaacctgctcagctgcttaccctgccttgcccattcctttctttgaaaaccacaataaagtgcctatggttttcccttgctccttctgctccttgatgctcccacatatggccctgtgtggcaaggcattgaaatgagagagttccctgattcccctcgcagggtatgagacagtgttgtggctcgcctgtttggttgccccccgcagctcagaccccttacgggagggggagcatgcagatgagcaggtgcaggaaccggggtgagcacttttgggctctggccccatggcagcatctatgggtgggtgtttgtgactcccgaagcccaagtgggcatgtgttacagtgtgctcctttagctttgccatctgtagatggcttgtgtgttaatcagctcaatggaccctgtgccttatcacaagggcagggggcgagtgtgacagccttctgtatcccaagctcttcctcagtgtcccaaaagaatcggatcacatgtgggcttgaaggatgagtgcagggttttactgagaggtggaggtggctctcagcgaaatggatgcggagccagaaggggggatggagtgggaaggtggtcttcccctggagtcggggtgcctagcaaccagactcttctttgactgcccctggccgaactccccttggcgtccagacgtccctcctcttctctctctgctgcattgttctgccgtcactggtcagctggtccgcttgcctcctcctctctttgcttggggttctcttctggagcttggggttcagggtttatatggggccagggtagggggtgtggtggaccaaaaggcaactttttgggcgtgaaaacagaaatgcctgtcctcattagggcctctggtcttcatgcttgagggcggggactttgccagggaaccgccctcttctacccagtatttccctgtctcttgtccgtatcagcgtgccctctcatcttccaaactgtgagtaataaacccttttcaagggctgtctccatgtttgttgtcttaaccataccagattaaagcaaattccaagtgcatttcaacacaggagccacatcgatttgagttccaactgggctctgtcatttacccatcacgtgaccttcggaatattacttatcctcagctggctccagtgtccttatctgcaaaagattcctgtattgtaggactgctctaaggactgatgataatacacataaggtgagcaggcactgaggaaatagtagctgtgtgggaaggaggtgagaaaaaatcaatggataaaatcccctttaaggctcagagatgaacaagtagaacacatggatagatagcctctcagatgcgtatctccttcctaatgttcaattactagcagcaacacatcaggagatagttcatgtactgctatttttgttcctcaactgaaaaatgtaccccccaccccccaaattaaatgatggctgctgttcctgttaaggaaataaagcctgataattactcttttaaacaagagaattaaaggaagcatagtttatcgctttgcctctgctcaagtgtcactttgagatgctacacctgccttcactaattacccgataagcaaacttatcaagaaccacagcagagagacaagaggttgggatttgaaaccattctggccttaagacaaatactggccctgtgacctttcgcaaatcacttaatagcttcaaacttcagtttccttatctgtaaaaggagataagaacacctacctaaggaaaatgtttaaaaagatcagatacaatgtaagtaatgtatatcgttagtgaaaggcctgggatttgaactcctccagtctgaaggacctgccaataagtaacagagcccaccacaatccccagatctgagctttcactatttattttaatagctcttctctccctctcctcccttccttcttctttcctccctcttccttccaatggatggatgaaaacatttttcagaatttgaatcacttccttctttctcactaaaattatggcccgcatgggattttactgcttgaaacacaggaccctgcacatccaaataatgaccagatgcactcatgtctaacataaagacagcttcagctgtcatcccggccagttagcagcttgggctgttgttgctggattccgttacctcggataaatcactgtacctgtgagtcctgcagggagagcagtaaatgcccaggcaagtcccttcttggggtggggctcggtccatctggaagccttcctcttgtcctgcaagctgcccattctcgcaagcactccttctggaagtcttcccaatgaatctaccgctctgggatttctgcttctctgggcactgactgcccttatggtcaggcctgcgtgctttagggtcatgtggccaagttgggtttcctatacagtattttcatccctgcatcaagttgaccagtccagaacctccggcatgggttcttggtcttgcttcataagggtttgcacagggctaggcatctgagaaatgctcaagaaacttccgttgattcattgattgatccagtgaatgtccaaggtagtcctgaatgttcttaattgaaataattgggtgggtgtagagcaggctattaacagacttaccttgcataatgacttttcaatgaactaattttcacatctctagaatagttgtaaaaatttttagaataacgccccctccccttttttttccagaataatgacttctcactcccaaacacactaaatcgtatgctaaatcataatattgaaatcatagtttcaatattacagtttcaggcaaagacacattcaccagtttccctgacacaacagtttctgttcaaagaatctcgaatggaacaattttgagttacaggtcaagtgtggataaacattttattttgtatgccatgtagatggggtgaagaggtagcattttttttttttttttgtcatagtcttactctgtcaccaggctggagtgcagtggtgtaatctcagctcactgcaacttccgcctcccaggttcaagggattctcctgcctcagcctcccgagtagctgggactacaggcgcgcaccaccacacctggctaatgtttgtatttttagtagaggtttcaccctggtcttgatctcctgagctcatgatccacccaccctggcctcccaaagtgctgggattacaggtgtgagccgccgctcccggctagaggtagcatcttttactactctttagtgcagaggttgctaaacttttcctgtcaagagccagagagtaaatatcctaagtttcaaaggccaaaatgtctctgttgcaaaactacttaactttgctcttgcagcatgaaagcaactatgcacaatctacaaacaaataggtgtgaccttgttccaataaaactttatttacaggccgggcatgatggttcacacctgtaatcccagcactttgagaggtcgaggcatgtggatcgcttgagcccaggagttcgagaccagcttggggaacatggcaaaaatccatctttactaaaaatacaagaattagctgggcgtggtggcgcaccacctgtagtcccagctattcgagaggatgaggcaggagaatcgcttgaacctgggaggtggaggttgcagtgagccgagattgcgccactgcactccagcctgggcaacagagcgagaccctgtctcaaaacaaaacaaaaaggtgaaaaacaaaaaaagctttatttacaaaaacaggcagtgggccaaatttggcccatgtactcttgtgtacagacccctgctttagtcctgtgagcacctattatttccctgtgctttgaacttctttattttgccctaaagggttttttttcttttcttttttttttccgtgttactttaagtgtggtttattttgagggcaagataatcatcatctcctaaaaggctgaaaaattaatgcagaaaatggcacagaatgaacaatgtaccttgtaatgaatgattctcccacatcctttcctctgtcagtcccgccactctcaagttttcctttattcctctggtgaataaaagaaaccttcattacattacattacacaaattatgcttattttcaatattttgacagttctatattactcttacagacttgttttcattgttcaagtaatacattttaaaattactttttttaatttttaatttttgtgggtacatattaggtgtatatatttgtgggtacatgagttgtttcgatacaggcatgcaatgtgaaataatcacatcgtggtgaatgtggtatccatcccctcaagcatttatccttagtgttacaaacaatccaatggcagtctttcagttatttttaaatttacaattaagttaaatgaatacatttttctatctgtgtttgcatatcttagtttgggatagaatgcatcataattttcctattacaattaatgaaagtattttttttggtttaatggcttttcactcagcagttgaccgttcaggaatgaattcctgtcggtaagtgatgggtaggtataacttcagggaatccccaaattgccctcacctctgggggaattgcaagttcaaggcaggtgaaggctactccagctaggaactcacggccactattcaatgtcagtggggacactgaaagttgtgaggagattgagaggaggaaggaaagaggaaagaagtgagtcctggtgtcgtgcttgggtgactgtcctctcgctgtgcacaggaagctttgtcaagcagcagacatgccatgtatggcaatgatcccatcccccatctatccatttgtgattttcccatgccacctgaggccattccttggtctcagtgtccttatttgtgaaacagagttaaaatacctttgctatcaagtatgtagatttaccatgaggttaaagcgaatgtgctatgcctatatgaagtatcacttttagttgagcattgagaaggaataattagggccttgaaagatgacacccttcctccccccgcagacattagcatgtgaggttcctgaagctgaagctggttgtttgttgtttgttgttgttgttgtcgttgttgttgttttgagatggggtctcgctctgttgcccaggctggagtgcagtactgcgatctcagctcactgcaacctccgcctcccgggttccagtgattctccgattctcctgcctcagcctcccgagtagctggcattacaggcatccaccaccacctccggctaatttttgtactttcagtagagtcggggtttcgccatgttggccaggctgatctcgaactcctgacctcaggtgatccacccaccttggccttttggtttttttgagacacagtttcattctgtcacccaggctggagtgcagtggctcaatctcagctcactgcagcctccacttcccaggtccaagcgatttttgtgcctcagcttccccgagtagctgggattacagtcacgtgccaccacacctggctaatttttgtatttttagtagagacagggtttcgccacattggccaggcagatctcgaactcctgacttagagtgatctgcccacctcagcctcccaaagtgttgggattacaggtgtgagccaccacttctggccccgaagttggttttttgttttgttttgttttgtatttgtttttttccagacagtcttgctctgccgcccagactagagttcagtggcatgatctcagctcgctgcaacccgcctcctgagttcaagcaactctcctgcctcagtctcctgagtagctgggattacaggcgcctgctaccacgcccggctattttttgtatttttagtagagacagggtttcaccatgttggccaggctggtctcgaactcctgacctcgtgatccacccgccttggcctcccaaagtactgggattacaggcgtgagccactgcgcccagctgaagctggttgttaagagtaagtggctagggctaacttgtatgatttttattgctctccttttcactgtgaagggccaggaaatgtcgatgttggagctgcaacattgaacatggttcctgactttgtggaactcatggtctaagatgtgttctagagtgaggtccaaaaactcttgggagaatcccatactaggggccaaagtcctgctagggtgtgttatggaataacagcaacaaaataatgtcaacagccaatgagcacaggataactacaacacaccatgatgtcataacttggacaaaggcttgtgaccccctgactttggcgcaacatgaaatgagcagaaagtaaggtatattatggaataagccccaaaacttgagagaatcccatgctaagggcttaagccctgaccaagacaagccagacaggaccatgaatgtgtggccatgttatactgagctcatcagcacctgctgagctcctgtgtcacctctaaagccatgcgcacaagttttgcattgagataattgctctactggtttctagatatagttgaattctccacccccactcccactgccctatgacctccagcaaaacaaaagcaggtaggtagtaattgtgttgtgagttaacgatatctatatctttggataataaaatctatatcatttcagtggtagcattggaatatcagttgcccttccccatgaagaaagcacattgttatcgtttaaatcattatcataatcaaaaatatcaaagacccagtcattcatcagtctttccagtgaagtcaactgcctttgttttttgtttgtttatttttgagacagggtctctctctctgtcacccaggttagagtgcagtggcgcgatctggctcactgcaacctccacctcccaggctcaagcgattctcccacctctgcctcctgagtagctgggaatacaggtgctcaccaacatgcccggctaatttttgtgtttttagtacaaacaaggtttcgccttgttggccaggctggtctcgaactcctggcctcaagcgagccccctgcctcagcctcccaaagtgctgggattacaggcgtgggccactacgcccggcctgaaaccaattgcctttgaattcatcctggggaatctgctgaagtggacagtttatgtaaacacaaaaacatcctaatgaatggctgcctcagtaggagtggcagacaaaacacatggtgcacttttcatcaaaaacacacaaggaaaaaatttttcatcatatcttttgtagttgctaataaacttaattcacgcacttgtgtttttttgtgggtttttttttttgtacacttcttagtaccacaaagaggaagtgctttttctccttcctttaagaaaaagttccagttcaaaccatcagcctctgtaggttgtcttaattgctactttgcactgcactggactatgactgatttttggcacatgctatcatacacaaagttcctgaaataaaatgctccaggatatcctaggaactcttagaaggctttaaaaagggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagaaagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctaggtaagtggagtgcaggaggccgggggaactgggtgtgtgtcgagaagtttccttgtgctttattgtagcaaaacttgtcataacacaggtatagggctgtttgcctgcgttcataggtggtgtatctttagtttctatcaaatatgcaaatgataaagaaggcttttttaaggagcctaaataaataaatacacccaagtaccaaatgtatagtccagaaggcaaagtgggtgtaagtggcttcgagtggctggctgattctgttgcattgggtggaaaattttttatgtggtacatttagcaaaatgagtgtttgtgaattcatagtcacatagtttcatttatattttgaggaaagactttacattgtgatgaaaaccatgctggagtgtctttccatttgacttttattaatgtttgcttgaacgaatcatgaaatttaattcacaaaacacaaatcagtcctttaaagtgtgcttttaatgatattcttcaattcctttcttatccagtgactctggtgagatgcaatttgatttacaaattaatatgaaggaaaacagaggttttcccccaagatttgaaagatattgtgattcagttattttaatgactgttggtgagaatgatgtacccagagagtatataggatgatagaagtgtattcccatgaaaaagaatcaaatatcttggaaaggagtgagggattttctaaaattctaggctttctgaacccttgactattaccgttttaatttttctcatacaacccataatacttcattaacttgaacgttacataggaacgaggagattctaggtgcagtttgaaatgtagcaaacctgcaggaggccatgtttattttggcaggggtaaaccagtaattaaactttaaaagagttagggttgtgtggttgaaaactgctaaaatgagcaaaccatctttccacgctttctgtggctgaagatttaggaaattagatgggtttattgctttctgataaagcgaaatctcctactcctgcaactgaatctgtggctcttgaaaactcttgtaagatttctcagcacttagggtttaaacaagggtcctctgctgaaattccaaacaagaggaaaaattctatgggcatgccaaaagactacaggctacgtgcaacgtgactgcaaggttaggttttgcaaatgctcccaaacttaaaaatcccaataattattgtttatgtaaaaatatgtactctttttaacgatattaccactgcacgaaacttttacaaaactctacttttatgattacctcctgaggccgtggcatatcggttgaaagattctccgcggcagcaaatctttgttctttcagagaaaattattctcaggaaatagtgccgatgtttttagagcaaagtaaaattcatcaagccagacgctactattatggataaggaggcctgcataaaatatgaaagagaactttccagcgtgcccaataacctggctctcaccttgactctctaagaggagctcaaatgatgttagagaataagggcaaactgaggctgtggcctctacaactttgcttctcaaaatggggtctgtggaccagcagcattagcatcactggggagcttgagctccaccccagacccgctgattcacaatctgcattttcacaagacccccaggggactgtttgcaaatgcaggtttgagaagcattgcttcaggtgaccatatctatttggatgtatacattcagggacacttctttttgtcaaatatttctgcactattttagaatcacccccttaccccctctccccgtccctctcctcaactctgccacccacctccactctgcacccaggcaaagtgcttgtctgaaaagctccagggacctgcctggcaatgctcttcatgacaatattctagttagggtcgtcgtctcttcaaggggcttcctgcttgactttgtggtatatttctctgcctgtccacattcacttacatgcctgcaatttctagcatcccttcgtacctcatctttgtatctgaggctctgggataatctctcctcgcaaccttagtgcttctacagtaagagtgattgccagtggtcttgcagtggcttctgagaagctacagagcaccagaatggaaaacctttcttcttctccttcccctctctttcctccccacaatctgtttctcagatgcactggctggcaaactttttctgccaagagccagatagatagtgaatatatttggctctgtgggccatacggcctcttgcaactactcaattctgctgttgttgcacaaaagcatccatagacaatatgtacacaaatgggcatggctgtgtgccaagaaaatctgatttctagacactgaaattggaatgttatatacttttcatatgtcatgaaatattattttcctttttatttttcctgaccatgaaaaaaatgtaaaagccattcatagctcatgggctgtacagaaacaggcaatggatttgacctacaggccatagtttgctgacccctgctttctggccattcttatgctcttgatctgtggatgactccactgcatcctaagggcatttcctctggttatagagaaatctacaatgagaaaccaaactgctatttacatgtattttttaaagctcctaaccattcaaaagtaacatcttaatttttatattaaaaatattttctttattgtctctatttcattcacttacaccttcacattatctgggcttattgatcctcatttatttggagaattttaaaataaccccatccatggagataatgctcttccttgaggggttgggtctgtcagtgtcccaattaattaattatacacacacacacacacacacacacacacacacgtacatatatatatatatatatatttttttttttttttttttttttgagacggagtctcactctgtcacccaggctggagtgcagtggtgcgatcttggctcgctacaacctccgcctcctgggttcaagcaattatcctgcctcagcctcctgagtagctgggattacaggcgtgcaccaccacgcccagctaagatttgtatttttagtagagatggggtttcaccatgttggccaggctggtctcgaactcctgacctcaggtgatccgcccacctcggccacccaaagtgctgggattgcaggcctgagccaccgtgcctggcctaattagttatatttaaaaccttccttctgctcatcgttagataaagatacctgattttacttcttcctttgaggttttgggtcaagaattatctctcatgaaaggaataagtctttaacgattttattagctattttgttttttaaaataaggctaggatcaagaaggtattgtccagaattataaaaatattatttacaataaagcttatttttgcattatataaaagaacacatgctcactaaagaacattaggtcaacatataaaaattgactgatggggaaaattccccctgaggttctgccacccaggcatattggaatattgcacactaatctttatgctgcccatatatatttttttacataactttttttttttttttgctttatacagaaatcaaaacacacctttttgctaagaaacttattttcttaaaaacaggactgagatgggccaggcgcagtggctcacacctgtaatcccagcactttgggaggtcgaggcgggcggatcatgaggttaggagatcgagaccatcctggctaacacggtgaaaccccatctccactaaaaaatacaaaaaaattagccgggcgtggtggcgggtgcctgtagtcccagctactcgggaggctgaggcaggagaatggcgtgaacccgggaggcagagcttgcagtgagccaagatcaccccactgcactccagcctgggtgacagagtgagactcttgtctcgaaaaaaaaaaaaaaaataggactgagatgtttcatcggcagttttcttgaatctctaatgtaacacaatgcaatgcaaagaggctgtttggaggatggcagcagagaaaaagaacaaaggaaaagcaggctccatttagagagtgggttaataaataataaaaactcgccacactgggtagtaatctacaggtcttccatctctagcagaaatataggtactgccgagctttctgccacagagggccttggtccccattcacctcccaccatccctctccccatggccacatctccaaatgattcattgtttctgctcacagagcacagcaagaatgaattccccagaatttcctcagctactacaaatacttttgaaatcttaaactaacatctgctaatgcccaggtgctacctggggttgacaaattgggcacccttctgtacttctgcagacacctatttagataatgttgccaggcagatggagatattaagccattggtgaaaagctatttcaattttagacttttttttttttggagtgggggaagggaggaaatagctggaagcttggtccacaaagttgcaaatgtctggtagctaagctgggcctggtgggcggagagtttgtggggttcagggcaggcggacaatgactgttgctatcaataggtgattgagatatgttcagtatattctttacccctaccccttttttggtccgtatctgtatggatggtttagataagatccagaactctaaaagccaaacatgctagctttctatttccactctgattggctccaaatgacatagtttaaaagtttcaattttcccatcttgaacatgggcatggagttataaaccaatagagtgaaagtatgagacttaaaccactgataattggaggctgaagcgactttagagagtgtctcgcccagtggtgctcatatttgagcatgtatcggaatcacctggggggcttgttaaaccgcagatggctgggccccacccccagggtttctgagtcaagatcttggagtggctttctaacaagcttccaggtgcagcagcagcagctgctgctgctctagagaccacactcttaggagctctggtctagttatactcacttatcttacgtacgagagaactgagtttcaaagcaaccaagagtcttaccaaggttatttagctagcagctagagtctggtttcgtgacattgaaccaactgggttttggaataccgtgtcaacactgagaaggatgaactgatatcaaatatcttgcgtatgtttccgagggtggtttaccggatggtggtctgctacaactcagccatttattgtggtctgttttttcagtgagtcaaggtctcttaagtctccaagctaaacaggagtactgcctgaagccagaatgcatcgaagcgggtaagtcacagttttccatcctgtgtcaagttataattatggtaccttgggaagtggaagagaagacaggtggtatttttagtattctgtttgcttgaggtttaccaagtacgaaatgcaattttgaagaaattttaagtttattttcaagttttggtgtgaaacagtggagcttaggtttcctgttttctttttccttgcaaaaactgtggtattctaagcgttgttacaaggaaatcaggaaggggcttggaaggctgaatggcctctcttaagacccacaggcagagaacattggtcttcctatggctccgctggctatgaattcctctttaccttaagcagttgcctatcttctggtctgtgggtctgacttgcctgcctctaagcaaggctcctttgcaaataaatccacgcttccattgtcagtgggagtcccttttctcttttttaaaaattgagacggagtcttgctctgtcgcccaggctggcacgatctcagctcactgcatcctccacctcctgggctcaagtgattctcctgcctcagcctccctagtagctgggattacaagtgcccaccaccacgcccggctgatttttgtatttctagtagagacggagtttcaccttgttggccacactgatctcgaactcctgacctcaagtgatccacccgccttggcctcccaaagtgctgggattacaggcaagagccactgtgcccggctgggaatctcttttttctgtcacacgttgcaagtcaaacttctcttgaggtgaccaggctgtgtatcagtggatatcccagggtgaagatgagtgtttaaagtggccgcagttttgccacagtgtcttatcccatcaaactcatggctggagttgccccaaaagcagcaacagggaaattcccatgagggaatatcccatcccgagatggggccagttgggattccaaagaaagaagcactaaataaatgccagggcggccggtcagtccaaagcatttattagtgcaacttatgttgaaagtgctgcagtgtatcctcaagacagtgagagaaaaggggtgttctacttagggcattagggtgtggagactatatgcgggtttaaggaatttggctcagagccggtactagtttctttcagtgttttgtgcatcaacctagatacctttatcagtgcctgggaatgttcaagggtccagtctggacctaagcctgctgggaaaaaccagcagctggaattagccgggcatggtggctcatgcctgtaatctcagttactcgggaggctgaggcatgagaattgcttgagcccaggaggcggaggctgcagtgagctgagattgcaccattgcactccagcctcggtgacagagggaacttctgtctcaaaaaaaacaaaacaaaacaaacctgcaggtggctgggtcacagagtggtcaggggattgtgtaatttttggttaggacaccgaaagcggcggtggggaggtgaggggaaacctgggggtcccacacacagctattagatttccctcctaaatcagtgttagggcctagatttcagggagccagattctagccctcaccctcattctttaagtgggcagggacacttttttcctttttccaaaaggaaagtcatcaaacaagcatgtggccctttcactttcctcttggccttaaaaggttaatgaacaaattcaccaaatatttgttgcacatgaggtactgagttaggttttggaaatagagcagtgaaccaggtatgggaagaaagacaataaggcaattaatacaatgagaaaattatgaaactgggtgtggtgacacgtgcctttagttccagccacatgggaggctgaggcttgagccctggagttggaggccagcctgggcaaattagtgagaccccatctctgaaagaaagaaagaggaatatcagtcagtggaaaatgttatagagaaaattaaaaaaaagatagaacaatgtgatagcaagtgacaggatggctagattgaaaagccggaggacatgaccttggaggtgacctttgaatgatgaggagggaactgctgtgtgaagactgaggcaagggctttccaggtggggggaacagatggggcaaagggtgcatagaagcatgaacttggtggacttgaggaacgggaggagcttgctaggtgaggtgcaagtgatgaggagtcaatgggggacccaagtgccagtgagtttgggctttccttaagtgtgctcgaaagcctctggaggcttttatgaaagagaatacatcttaggagcatttcaaaagatgtctcggtggagggctcagttagagggagtctttcttgatggagaagagaccatagggagcaagaatagaagaaggtgactcaagtaggtttatttctgtacgccaggtgacagacgatgctgtcttgaattcaagagatggagagggagaatgggggaaggtttaggaggtagagggcctattgaaggattcgatgcaggctgtgaacaaaagcagacaattgtgggtgacgcttagatttttggtgatggttgggcagtggtgtttattgagatgggaaacacttaggtgaaagagcttgtaaattcggagaccttatacaaaggtagtggcttagataattatgttagtagagttctttttttgttccattcttaagtgatctctctctctctctctctctctctatatatatatatatatatatatatatatatatatattttaaccaggctgtgtgttgagtgccttacaggcaccatctcataaaaccttcataagacccctatgaagtcagtgctatcaccagcctcactgacagatgaggaaatggaggcttctggaggctaaataactgcccagggtctcatcctgagttagtagcagagctggacttcgtgtccatgtctggctcctttccgtcttttccttggtgatatggggccatgccaggcaactctttttggccctggaactatctgagaactcccaggccctttcctgctccaggcttgagtagttgacctgaggttttctccagtggtgagagattgtcatggagtggggtgagagagcaggcggaactatcaggacaggttttagagtttatgtcacctggtgctttggctgtggtggggttcttgcagatgtgtgaaatgggaatttttgagctcataaattttcaacttgagtttagaacacttttttgtatggaaggccacttatttcatgagttttagttctgtattatgaatcataataatgcaagactaaaacttacagactgacattcaaagatgttgccttctgccagctagtgtgttctgccttgctgtcctgtttttaattttcacattggcgaatggctttctaatgttgaaaaaaaatattgattttgctgtttctggagtgaaaggctcaccaaagacccagttctctttagtgtaacgtgagcctcagtgtgcccaggggtctgcagaacagctgtgagtacacatggcaggagaattacggccaagccagggccttaaacaagaggctgtgcgtgcgtgggcgtgcatgctgaaagttcagaagactagagtgtttgatcgccttctggaccatttctgagcaggtgccaaccacttctgagatgcttcctctccataactctcctcttctctgtgtcctcttattttaatccctctttcaaaataagagctgtgcaaagaatgcaaagaaacaaggaaagggcatgcatgctcatgatcacagataagggcagacaggctgactgggtttgaagcatgatttagctatttacaagccacatgatcctgggctaaatatatagccacgctaagcctcagtctcaccaagtgtgaaatgggaataacaggttttacttatactagtcgtgagaataaaagaaaataataatggactgggcacggtggctctcgcctgccaccccagcactttgggacgctgaggcggacagatcacttcaggccaggagttcaagaccagtctggccaacatggtgaaactccatgtctactaaaaatacaaaaattagccaggcgtggtggcgcaagtctgtaatcccagctacctgggaggccgaggcaggacaatcacttgaacctgggaggtggaggttgcagtgagccgagattgcaggttgaatctgcacttcaaccccaagggggaggttgcagttcagcctgggcaacatagtgagactccgcctcaaaaaaaaaaaattagaaaaagaaaataataatggtagtagcagtaatttaggttcacaatgctgattcttaaccccaaacccagaaaacgatgtaactctcagttggcaagatgggggcctgatctcaattcctttgatggcaaaattggatcttaactcatgtgaggctgcttcagatttcatttatcctacttacaagaatatgcatatgtttccctatagaaacattaatgcacttgcttcaggcctgccactccagccattgctgaagtattacatgatctgtggttatatgcaatgtatttattttctaaaatctgaaaaatctatgagctctgaaacatatctaacctcaagagtttcagataagtgattgtggaattacagttcccagatttagctaactacatacatacgtacatacaggatgcttagtgaaatttgattgcagatacacaatgactactttttctggtgtatgtctcatggactatttggtacctacttattctaaaaggtggttgtttatcagaaattcagacttcactgggcatcatgcatttatatggtaatgtgcccaacactattctaagcactttacatatatttaatttgcataatgattccatggggtgctattattatccccattttcaggtgaggaaactaagacacaggttaaatcacctgcctaaggtgtcttagctgctgcatggtgtttctctcattcaaacacaagtggtctgactagagtttgtgacgataccatattgctaaaaaagggcttagcgtaggtcctggcaaaaaggaaatactcaatattggtgattttattattgttaattattattattactactctctcccttcatccttgattaaatctaaaaacagaggctggtatttagggaggatgcctccacctctaccacacaaacagcaactggtgactgtgtgacaattaaccttatatatagtgacttggaagagtacacagcctgagctttcacagatttccttcatcatcatatttcttttattaaaacaagactctgggttttctccatggagctgagtagggggaaaggcgttttggtgtcttgacaactatggtcccttgcaatttgaagtcacagttcccctgcagaaagtgcagccctgtgccccgctgtgaattgtgaatgatgaattgggaggctgcaactagagttttctcactcagcaggcttctttccaaattcaatgtgagtgatgtatttcccaacttttgtatcagggccaaggtcagagctgaccttgcagtttttctaggtacctgcaagaatactggcgagatggagaggatacatttgagggttgggggcagggaaagtttgagaaggaggctggaaaacagtgtactcatgtgggtaaaaatgcgtgtgagggctcccctgtgtgactgtaaatgttgtgtgggactgagacgtgtgatccatgtctctgaggtgtcacatagcagattcattctgtggctgcatacagtaactataaataccaaccaaaagaaagattttgttatgtcctagcacatttgcacattaaatattaatgataaaatagtagcagtaagtggccgggcacggtggctcacgcctgtaatcccagcactttgggaggccaaggtgggtggatcatgagatcaggagatcgagaccatcctggctaatgtggtgaaacctgtctctactaaaaatacaaaaaaaaattagccgggcgtggtggcgggtgcctgtagtcccagctacttgggaggcagaggcagcagaatggtgtgaacctgggaggcagaatttgcagtgagctgagatcacgccactgcactccagcctgggcgacagagcaagactctgtctcaaaaaataaataaataaataaataaataataaaaaataaaaaagtagcagtaattaaaaatgtaattagagacaactgatgctagttctgaagcacgaaaatgttaagccaatttgaaatttatcaaacttctaagtctttatttttatttatttttttatttttttaagagacggggttttgccatgttgcccaggctggtctcgaactcctaggctcaagtgatctgcccacctcagactcccaaaatgctgggattacaggcatgagccacagtgtttggcttctaaaccaattttttgctagtgttttttttttgtgtgtgtgtgtgtgttgttgggggaggtttgaaaatggtggggattttgaggccctatagaaattagaatgtttttatattattcacttcattgaagacaaaaggctgtttgaaatttttgtagaaagtctaggctggagaaatatctagccttatttttaaacctggaggaaccacacatgtaaccaaactgtaagatatgtatctaaattgacacagattgtacttttttggggcagttcattcatatttagctgaaatctctttgggttttcattacttcaaacaaaaatatattctggcattatttaaagtatgaaaattgcccagaatgtcatcttttcaatgtcattaaaatattgtctggttttttaaaaaaatcaattggtacataactttgtgctagaatggtagccagcaattgcatggcagctggaagagcattggagttcaatattgggaattctcattttgtaatgaagggttttcttttaaagttcatggttacatatttatgcacacatctcctacctgtgggttatcttctatatgtaattgtgtatgggcttatgaaagaggaaaaaaatggtagatcagtctattgtgtctttctgttaacttatacacatactcagttctactgctagacctgggtccctcatttagaacaccctactttggccctcctctggccatgcctctccttcagccaaggcgtctgtggagccaagtaggcagccctctccttctacaccccagaattccctgcctgatggccccaagctcccttccaggatctctgtgagtctcttctggggcttcatttctctgagagttacactgaatatcaaggagctcaagaatttgaaagtattttgtaaatataacttttaaatatttagatagatgacatatgaacttctgtttccattagccttcactgtgaggcaaaccacccaaaccatagaggcctggaacaaaaatgattggatatttctcatgattttgtggatttggtggatggtttctctgccgatttttgcctaggctcatttgtgccactgcattcagctagatgggcgcctggactggaaggcgaatgatggcctcagtcaatgcctggcagttgtgctggcttggttcttctctatgtgtcctcttgtcctccaggaggctgcttcaaagggcagctaaagggctccattcaaagggagttaatatggaaggtgcaaggcctcttaaggcttagctttgaaactcacagaaagttacttctgccaattctgttggtcaaagcaagtgacaaggtcagtccaaattccaggcaggggaaatagactctaccacttgatgggaagagcagcaaggtcactttgcagaaggacaagcaggatagaagaaatagtcacagttatctttgcaaacaattgaccacacgctctatttgtattcttgtcccataccccacagatgttagggatggccctgcaaaaaccagtgatgataataccaccaaacttttatccattccctttttttttttttttttttttgagagacaggttcactctgtcaccccaggctggactgcagtggtgcgatctcagctcactgcaacctctgcctcctaggtttaagtaattctcctgcctcagcctctgagtagctgggattacaggcatgcatcaccatatctggctaatttttgtatttttagtagagatgggttttcaccatgttggccagactggtctcaaactcctgacctgaggtggtccacctgcctcggcctcctaaagtgctgggattacaggcatgagcccttgcacccggcctatccattcactttgaatgtagtcatttcatatagtgaggtagattcagagagtttatttaaggggaaatataaatgccaaggcttggaaactggttgatatggaattgttgtttaatttggaaaagaacagtatacaacattcagtgcttgtcattaatcctatgattttctttctaaatagctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaagggtaagtttctactggggtttggtgatacactttatagagagcaatatttgacaggaaaaacatagtttgggatttgaagcatgacttctcactttttaactaccatgctaaattcatttccaagaatttttaaaatgaaagattgaaaggaaagtttgcagaattctggactcccagatctcaacataagactaatgtaggttgttatgttcatgtttggtaatagtaaattctactgccaaaggataaagagcatttgattgagattggaagcaaaggaatagttaatgaaaattatatcaatatactcatttgttgtattcagagtaaacttcatttcttgctcattgtgtcctggattttcatggcttacaaaatgtacttaacacctcatcatcttttgacatcacttttgagaactctggatgaccttgtggttgtcatattgttcttgttaacttctaagttggctctagggagattcacttttctcccatggccactctagcaatgacaagctcacacacacatactcacacgtggatgcatagaaacatacatatgttctcaaatacattcccctgccccccgccaaagttggaaatgtctgttattggaggatattctgttagcattggatctaatttttatgctaagctattggagaaggccacctcaggagggaagtaggaagatttcaaagccagataaggtaattattttgagaaggcaaaaatagtatggtttttttttttggctctttttgacaactgtgagttacaccatgtaacttgcattcagtaacacctacaaagaactcctgagaaattataaaaatcattttcccttcccatttacattttcccaagattttaaatacatgaaaattaaatatgtatcattttacaataagtaaaactcttggcaaaataaataattagatacctattgtcaattgtaaggaaaaatgtacttaaatttcacaactagatataaatcacatggacttatattttctattaggagacccaaatttagtcttggaaaattataaatgggaatttacaaggatgtcagggttttctcctaacccaaaaggaaaattctcatactataaaatcataaataagaccttgaggagtgagtttactaatacttttttccctgtagaacattaattcatgttggtctttgatttaccattcttgtccatttcctatttcccttctctggcttttcttaatagacagatgtgtacacacacatgtgcacacacacacacacgcgcgcacagtcatgcatacagaaacattactgaaagataagaaaactacaagatttccaggcatatgctccttttgcatttgttataacccaaagatttctatattcaggacatgaagtggttaacgataacttaaataactttccaggggtgtctggaattttaacataaaagttaaaatcagtgtcaatatgctttgtttgaggagggtactgtctacaggctccttcaaaatcaatagaaatgcaagtaaattgttaagcacagggtttttgtatttgctagcttccttttaaaaatcaaaaattttatttctcagctccattgaagaaataaaaaaagagcaaaaattagaagaaaggtcgctcataaatccgtcacaagaaataactgctaataaagcaactggggatatttctttccaggttttgttgcatgtgtgtgtccatatgcataacttcatatgcacacctatatattgtaaaaattagctgatattatacatactactctaacttaatttttaaaattagttggtattatacatactactctgtaacttaaaactatgcattcctcatagacatagattatgtcagtagataacttttcttttctttccttttctcttttcttttctttcctcttgtcacccaggctggagtgcaatggcacgatctcggctcactgcaacctccgcctcctgggttcaaacgagcgattctcctgcctcagcctcccgagtagctgggattacaggcacttgccaccacgcctggctaatttttgtattttttagtagagatggggtttcaccatgttggtcaggctagtctcgaactcctgacctcaagtgattggcctgcctcagcctcccaaagtgctggggttacaggcatgagccaccgcgcctggccaacttttcttattataaataacactgtaataaacatccttgtgtacacatctttatgtccttatctaaatgtatccttaggataaatttccagaaatggaattattgggttgaaagagtactctaaatttcatttttgatgcatatagccaaattgccttttagaaagtttatttcagctgggtacggtggctcatgcctgtaattccagcactttgggaggccgaggcaggtggattatctgaggtcacgagttcaagaccagcctaacatagcgaaaccccggctctactaaaaataaaaaaattagccaggcatggtggcacctgtaatcccagctactcagaaggctgaggcaggtgaatcacttgaaccaggagggagagattgcagtgagccaagatcatgccattgcactccagccggggcaacaagaatgaaactctgtctcaaaaaaaaaaaaagtttgtttctaggtctttatatttttttgatgttttaaaggataactttttcccatcaactgctttctgtggtataaagtagaagtcatcaaaccattgccagtaggcaaaatccagtccactgcctggaagttttattggaacacagccacatccattcgcttatgcattattaatggctgcttttgcactccaatggtacagtcgaatagttgcaatggaaactggatggcccaaaaagcctaaaatatttactctttgacctttatagacagtttgccaatccctgatgcctagtataaagtaaagctttgaatgtatgtattggattcaattagaactgtcttattagttgatagctccttggtagcttctttgaatttcttagatagttaataaagttaagaaataccagaacaggctgagcgtggtggctaacacctgtaatcccagcactttggaagaacaaggcgggtggatcaccttcaggtcagaatttgagaccagcctggccaacatggtgaaacctcgtctctaccaaaaatacaaaaaaaattagccacgcatggtggaaatcccagctcctcaggaggctgaggcaggagaactgcttgaacccaggaggcggaggttgcagtgagctgagattgcaccactgcactccagtctgggcgacagagtgagacttcatctcaggaaaaaaaaaaaaaaaaaaaacagaacggtgttgaaataatagcaatgataatgggtgtaattttcttatgccttgcttgggtggtaatgcctccagtatttcccctgaaaacgtacactttttttgtttgtttgttttagatagttattcttttttgtgttctgttgttcctagtttgcaaaaagctgctgctcaagaaaaatgcctctttgccatttatcaagagactcagatggagtatctcttttaacttatcttgatttacccatgctgaactaaacttataattttgaaataaatcctgcctattaatggtttgtattttttaagacattaccagaattgaagaagctagcattttgtttcacacatttgtctctatatttatgattcatattggtttgtgattgttttgtgtgctaggtttgtcgaattctgttattaagattgtgctggccttgtcaaacaaagtgggaggcttcctatatgtgtttctatgctctgggaaagacataattcaataaatcccaagttactctatgacaagcactgtaaaggccaaattcacaaactgacattagggttcttgcttcatatgtcaagaaggagagcaaatggtggaaaaggatctcttaaaattagtattttttaacaaaaataggtaaaatataaaatagctggacgcagtggctcttgcctgtaatcccaccactttgggaggctgaggcaggtggattgcttgaggtcaggagttcaagaccagcctggccaatgtggcgaaaccctgtttttcctaaaaatacaaaaatcagctgggtgtggtggcaggtgcctgtaatcccagctacttaggaggctgaggcaggagaatcgcttgaacccaagaggcggaggttgcattgagccaagatggtgccagtgcactccagtctgagtgacagagtaaaattctatctcaaaaaaaacaaaaaacaaccgcataaaatatctattagatttaaaaactttttattttgagataattcaaactttgataagttgaacaaatagcacaaggaacttctatgtaccctttacccagattccctgattattaccatttactacatttgttctattatatatatactttcattttccatctgtaaatatatatatagtgtatcatcctctacatatatacttatatacttttatacacatgggcagatagtatatgataaaataatatatctataaatgtagagataaatatcgatataaatacagatacatagatttttttctgaactctgcaagtatgttacagatgattagatattcttaaagtgtatagaggttttcaaatgtcaaatgtgctaaaaatcttatttcttttcctgaaacactgaatctttaaattctatctatatcttttaatatattctatatctatctatttatgtgtctgtcagtctagctacctagtcatccaactatctattcatttatcattctatccaggtaatacaggctcatcgtagaccaaccacaaataaacagcaaaagaagcatacttcaccacccagcaataacaactttttaaatgcaaatataggtataaaattatacatatcttctaagggatcatataatacattctatttaattaatttatttacttatttatttatgacagagccttgccctgttgcccaggctggaagtgcagtagcacgatttcagctcactgcaacctctgccttttgggttcaagtgtttctcatgcctcagcctcccaagtagctgggattacacgcatgcgccaccatggccagatcatttttatatttttaatagagacagggtttcgccatgtttgccaggctagtctcaaattcctggtcacaggtgatccgcctgcctcagcctccccaagtgctgggattacaggtgtgagctaccgtactcagccggatatactataatttacttaatcaatgcctgtgttatttaggttattttttatgttttcttcattgtaagccacttggaacatgagtttagaaacatcaagagctggatttgaatcctgattccctttcatttaccctctatatcactttgggccaattactgatctcacctagttcagttttcttatctttaaaatggagataagaatatacatatcagagtatgcaaaggcatacagagtggtgtaatagaccttggactcaaaggggggagggtgggagaagggtgaggaataaaagaactacaggttgtgtacaaaatacactacttggtgacaggtacactaaaatctcagacctcaccattatccagttaacctacataaccaaaaactacttgtaccctaaaagctattgaaataaaaaatatatatattttgaaaaaaggggaaaaaaaggaatacccatatcatagggattttgtgaagattaaaggagatgatttatataaattacccagtccagttcctggcacatagcaggccttccgtaaatatttgtcctttgttcctcgctttgtttcaaagatagttctaagattcatgaagtaatgtctatcaaatgctttaagttttattctggtattatcctttgtgtaaatatcatgtgctttcaaaaatattgaatactgtcaagatatttttgctcactcttgataaaaagagagaacatcccaaaataaaacccaatactaccaatcgaaagaataccattttcttaaggctgatagaaaacacacagatacggctgtccaatttgtgaaataaaatggacttgacagacctggctgatgaaaaattgccctctactgaagtgagcaacctggctttgtgaatttttttctttaaatggcatataagactcagattccgacttgggaaataaaattacttcctattctctccaagaagtgagattttttaaaaagccgaatataatcatatgtttgtcttaagatccacattctataaaccccccaaatttgtcttcatgtgaccatgaagaagacacagcatgcattgcttatgaatgagcagatggaaatttagcaaatgagcacttatgaaacatgaggcaatgaatgagatagaacacttatgtcacacagaagacagatgactcaaggtacggccagatcatctctattacggaatagctatctttgccaatattttgtgaagaaatgcaatatattattttcaagcccagcttcagcagaacaataagatgaagtagggactctgcattaatgaacagaaagagatgattgtgattcatagaccatttatttgtaaataccttctggctgagattcaaatagttctcgtaattaaacaccaccccctccccaaataatctttttttctgtaaatgatcctagccaaatcatcttttgcagacaatggaaatctgaaaacttcagttcctataaagtcatttagtgattaggaagttcagattattgaaaacagtgaattgtcattttcctcatgttgtatgtatagtagagctttgacttcataaagttcttaattttttaaaattattttattattattttttgagatggagtttcactcttgttgcccaggctggagtacagtggcaccatctcacctcactgcaacctccacttcccaggttcaggtgattctcctgccttggcctccctagtagctgggattacaggcgcctgccaccatgcccagctaatttttgtatttttagtagagacagagtttcctcatgtcggccaggctggtcttgaactcttgacctcaggtgatccgcccacctcagcctcccaaagtgctgggattacaggtgtgagccaccgcacccggccacttcatgaagttctttgaaacaagtaatatcagactagcaaatgtggggatgcagtggggaagtgctaaggaccaagcatccattgtggtgggctttttattactagtgaaaactcagcttctgtaattttgtgtgagtctcctatgtaaactgggtgcaccccttcagagaagattcccatttttctcagatcatgctggctctttttcacgtggccacatagaaagcaacaaattgccaagttacaaatatatcaccacagtcctatatgtgcaaaggggtgctgcatgaagatttgggcctgtattgaagacttttggaatgtgagattaaataattttacttgaaaagtttgttgttattcatagttttcctgctctgatataccgtttgagtattggtaggtgtgcgtgctgcatggagtgtggggagaaggtaagaagttgtcagattagggctgggcgtggtgactcacacctgtagtcccagcactttgggaagccgaggcggttgggtcacttgagatcaggagttcaagaccagcctggccaacatggtgaaaccccatctctactaaaaacagaaaaaattagctgtgcatggtggcgggcgcctgtaatcccagctacctcagaggctgaggcaggagaattgcatgaacctgggaggcagaggttgcagtgagccaagatagcaccactgcactccagtccgggcaacagagagagactccagctcaaaaaaaaaaaaaaaaaaaaaaaaaaaaaaaaaaaaaaaaacagacctagtgctagatatgaaatattcccaacacacaaaataatgataaatgtttgaagcaatggatatcccaattacccagatttgatcattacacattgtattcttgtatcagataatcacatgtaccacataaatatgtaaactataatgtatccataatcattgaaaattggaaaactggacaaatatagaaatttttttttctgaaggctctgtggaagatgtgaatgtatctctaggatatgttctctttctaaatagctaaatgaactaaagaggccatcagagtgactactgtgtgtaaaagcttgtgttttggtagttctgacagtcagcctgtcaggttttctttttttttttgaggcggagtctcgctctgtcacccaggctagagtgcactggcacgatctcggctcaccgcaacctctgcctcccgggttcaagcaattctcctgcctcagcttcctgagtagctgggattataggcatgtgccacatgcccagctaatttttgtatttttagtagagacggtgttttgccgtgttggccaggctggtcttaaactccgatctcagttgatccacctgcctctgcctcccaaagtgctgggattacaggtgtgagccaccgctcccagacaggttttcttcttatgtgtgcttttccaccctcagtgcatgtccttgtcttactttttgactcttgtctgctctaagccttccattttaagatctgatctcttcccctattgctttaatgtagctcctctgtcattagcggtttctactacaaataagttgggtatgcttggtaagaaccagctctgttcattccattcattctaagttgtatgatattcagctggcgggaagttcaccacttcaaatagattgaaatgcacaacattttgattgtactactctgtgaaaatagtcttatttaccaagcatttacttttattcctggcactaattgctttcaatcgtaagtaacagacagcccaactcaaactggcttaaacaataaaatatgctgattcatgtaaccaaaaagcctagtaattatgtagacttcaggtaagggctgatccagcaactgaaccatgtcattaaggatcacattttttttttctttctctctctactctgacatccaccatgtcgtatttccttctaagtctgtttggtcatgagattgttgctaataaccagaatttatacttcctcattcatatctagcaagaggcattgtgttagacacaagggatacagaagtacaaagattaataaggtcccctaggctgggcggggtggctcatgcctgtaatgctagcactttgggagcctgaggtgggtggatcacctgaggtcaggagctcaagaccagcctggacaatatggtgaaaccctgtctctactaaaaatacaaaagttagtctggcgtggtggcgggagcctgtaatcccagctactgggaggttgcagtgagccgaaatcgctccactgcactccagcctgcgtgacagagcgagactctgtctcaaaataataataataataataataataataataataataataatgtcccctagactatcctcatggaaattacaatctgcatcttatgagtgttcccataggtattgtaatcaatactctagaactgtcctgctcagcatggtagccgctagccactgtggcttttgggtacctgaaaatatggctaggtggaattgaggtgtgatgtaagtgtaaaatatacaccaaattttaaatacttcattttaaaaaatgaaagcactctcattaattgatagtttcatttataatcagtaattgcatgtagaaataatattttgagttatattaaggcaaataggatataccattaaacatctcacctgtttctttttacttatttaaatttagctacaagaaaattaaaaattacgtatgtggtttgggtaatatttctaccagacagcattgctctagagccctgaacaggctattagcaaggtgaaatatctgggaataactcaaatggatttcagtgctagagaaagctcagagaacacctttatttaaaatagtcctctggctgggtgccgtggctcacggctgtaatcctagcactttgagaggtcaaggtgggcagatcacttgaagccaggagtttgagaccagcctggccaacagaataaaaaacaacaacaaaaattagccagacctggtggcatgtatctgtagtcccagctactcaggagctgaggtgggaggatcacttgagctggggaggccaaggttgcagtgagccaagactgcacaactgcacttcatccagggcaacagagcgagactcgatctcaaagaaaaaaaaaagaaagtcccctacccaatctccaatccctttgtatttgtgtcctttgtggtccttataaccatctgaaatgatgtcatttgtgtacatgcttgctgttcttctcacttacacccatccccgctcctgtagatgttaaactccatgagaaccagccccttgtccattttgggtgtcactgtgaccgcagcaccaagcatagtgcctgccataggaggtgctcagtaaatacttcctaaagaaaggaagaaaagaatgtgccctctgtggttggctgagtgcagttgtgggggcagctgactgggtagggaggagtggctttttcttctccgtttcactccatctcctcctgtgcccacagtcccagaagactcttgagatgcaactggggcttgcccctgaaaggaggggaagcaaaatcatcagtcattttccatttgtgttctgggcctcaggaaggcaggacagggacgtgggcaatgagacaggcctgggcccttctaagactccctgttggtgggatctgatgcaagttacagacaagaaaaataacttgcaggtggttcaagtttgggttctgagaaaagaaaaaaaaaaagggattctgccacttatcagctgtgtggccatgggcaaactacttctttctgagcctccgtttcttatctggtgatactgttggacaaatccaatgagatgcgtagaaagtcttctacacatggttcaataaatggaatccgttgctactgttaatttcacaaggattaatgttttaaaagcacttggcacatagtagatgcttaagaaatgttctgcagccaaataaaaataacttagaagaagaccttgacatcactattaaaataaaatattgtgatctagttttttttctcaaactccccacatgcctgtaaataaggaagctggttctgaaagaggcaaggctggagataaaaaacagcagatgaggacatttgtacgtattcccaacttgcattgccagaccttggtcatgaccctaaaccctggacggttttgataatctaattgtcagataacacattcattggaggccatgtgatttttaaatcactcccacaggaagagaaagaagaggaaaagggaattggtaaaaataagaataactatcctcttacgccgctctagagcttctctggatgccacttaaaaaaattctaccaatttcccttcttttttcggacatggagtctcactctgtcgccgaggctggagtgcagcagcacgatctcggctcactgcaacctctgcctccccgattcaaatgattctcctgcctcagcctcccgagtagctgggattacaggcgcctgccaccacgcctggctaatttttatatttttagtagagacagggtttcaacatgttggccaggctggtcttgaacacctgacctcaggttttccacctgcctcggcttcccaaagtgttgggattacaggtgtgagccagcgtgcacagccctcatttccctttgttctctcttctttcttatccctaggggatccttaacttgagtccacagtcttcccacaagagggctgtcaatacaattcaggtacttggatgggaaaaaattgcacctttgttttcactaacctctcacagaattttagcattttctttaattatgaatgtaggcaacaaaccctggtactattagcagtgcctgtgactttgttaccaacagcaatcatgattatttttctaccttattgcagatgttgcaggtatcttgaaatgttatgtacacgtatcactacttcaaaattatagtagttgtcagactcaaagttagggcttggtatttaatgaattaatcaaatagcacatatatatatttcacacagtaaaaaaagttgtgctgtgttttgaaatacctgtttttctttgtaagcctatgtttcttattttatgtacttataaacattattctcagaatggtccataggtttcaacagactgctcaagagatgtaggcagaaaaaaccattaagaaccccagtgtatgtaaggattgctagagcaagattcaagaaggcagttttatttagctccagcctcttgatccatcttaattcaggtgcttggagtggcattgactattacgtggcctcatgggtccactcatgcccaaatctttgagtacttcactgtctagactcccggggtaatgagcatgttactgacagttaatatgtgtttatgaggatattagatgaaactggagtttgtaccagtaccaacccttgaactgattaaatgcagtctttatgattgtctatgccttggaacctgtatattttcaggtgaaattactaaggcttgccatgtgcttatcatgaaagcagggcattaaaggtcaattctgggcctggcagtgtacatctgtagtcccagctactcaggaagttggagagggaagaatgcttgagcccaggaattcaaggctgtagtaagctaagattgtgccactgcactccagcctgggtgagagagcaaagccctgtctcaaaaaaaaaaaaaaaaaagtcaattcttattcgaagtgatatagcttttatgaacagtgcaaatgattggaaatagtaatacaccaagtagagtgtttatccataagcagatactacatggtgtacaacagagctagcttgttattcaatgttgaagacaggggctgttgattgaacttagaagggtggggagtaagggagtaggggaactgcaaacctggaggtgctgggagctaagtcctaagggtcagatccaatatatatagcttggctttgttggaaggaaggaatgaacagggcctttggtgagagatgacaggagataagagatgttgaaatccattggtgagatttttgacttgcagcagggaatgctaaggtttctgagaagtggagcaatagcctgcaaaatgctatgcatgggaatattggctgaaaaaaatgaatgggaaagcagacaagggggcatttttgtagcataaatattgccacacattatgaaaagtttcctgtgagttagcttgaatgttgtaggaggaaagaaacatttcactttagaagattgtgggctaaatttaggttcctttgactaaatataagttcctcagcatgactaataacacaggatatgtgcatcctgagaaagacgtatacacccacaatgacacttttccacctgcccacacccaggtcctgttttacaaggttggtatgtttaagtgtattttactttgcagttgttcagaaggattgcatatttttgaaaaactacttcctgaaagaggatgactgtttggaaaggaaagaaaaatcctagctggctttggtggtaacagttgggaggcatacccacgtgagctttggtggtaacaattcctgaagcttctccaagggtccacgtgttcctgctgttggttgccagaagccagaataataatggagctgagaatatgggatttttgtgagaaattccaggggcattcagatttcacagcagaagcagatgactcagatgtcctgcgccttagagagatgcgtgaatcccttacctttaccatactctgaattggtcaacggcagaatggaagccctacaaaaattgaaaagttggttgcatgctaacattcatagtggaactgagttgaaaattttatccttgtatttccagactctctgattagattgttttagctatgctctcacccccaattctgagaacttttcaactgtgactgaggtgtggatgggtcaagcatctttacaatgtgacaaaatccccatttctcctctgatttactactaatggggagataattcattactgtgaagtgagcctttaatagattaaaaaagttgtaagaatatgtcacatagggcaggacctaacagggctgggcactttattgaggtgaccttatttaataatatcattagttatcatttattggactctgaactgagctcccaacacggaagatgtaagatttatctgcattttacagatgagaagacagaggcaccaagcagtataactagcccaaggtcacacggctgatatgcaatggagccaggattagatttgggccatttgacctttactgcctggtaaaagccctgaaaactaggaaggtgatattattcctgttttacgattgggcaaactgtggcttagagaggtgtattagtctgttttcacactgctataaagaaatacctgtgactgggtaacttgtaaaggaaagaggtttaattgactcacagttctgcatggctagggaggcctcaggaaactgaaaatcatggcggaaggggaaggaggcatgtcttacatggcagcaggtgagagagagtgagcaagagcagggcaaactgccttataaaaccatcaaatctcttgagaactcattcactatcacgagaacagcatgggggaagaatgcccccatgatctaatcacctcccatgacgttcttccctcaacacgtggggattatggggattacaatttgagaattctgccactgaaccacccatgcggggattagaatttgagatgagatttgggtggagacagagccaaaccataacaacaggttaagtaatttacccatattcacacaattagagacctataaagataccttccagagtagtattgtccgatagaaatataatgtgagtcacaaatgcaagtcacatgtgattttatgttttctaggagccacactttaaaaagtaaacgtgtcagcagttgggatgatatattttatctaccccaatatatccaaaatactgttatttctacatgtaatcaatgtagaaaacttacccatgaggcattttctcttttttctttcttactaagtctttcaaatgtggtgcatatcttaaacttgcaacccttctccatttggaccagccacattgcaatacccagtagcctcgtgggactactgaaaagtacaattctagagtggtggttctcaacccttgctgtgcagtggaattactagggagcttataaaacacagatgcctgaggcccattctcagagattctcatggaattgatctggggtgctgcttgggtgttaggatttttgtttgtttgtttgcttgttttttgagacagagtcttgctctgttgcccaggctgtagtgcagtggtgtgatctcggctcactgcaacctctgcctcccaggttcaagcgattctcgtccctcaacctcccgagtagctgggattacaggtgtgtgccaccatgcctggctaatttttgtatttttagtaaagacggggtttcaccatgttggacaggctggtctcgaacccctgacctcaagtgatccgcctaccttggcctcctaaagtgctgggattacaggcgtgagccactgcacctggctagatgtgaggatttttaacgacctccctcccgaccaggcagtgcccaaactaactgagtagaaaactgtagcctttgtacattagagaagtttctgtgagttttctgagatgagaaccattcagaatgactgctctggcagtatgctttgctagttgacattaatgaatgccaagcaatgcccaactaatttattaatttctctccatttacatttcccaacatgttgaccaagtctccagaataatataagaaaagagattttctttctcttgctgatttacacattggtctggatacataccagtgaaagtaaattcagacataaaattctactcttttaattgaggtcaaaggtgttggtgtcagcctggaatctctgagctgtggagaagaggaagttggggtttgaaagctgcaggtggctgccagaatgagacaagtctagtggggaatgcgtgggaggtgctgggtgaagaaaggaggcaattgtgtttcgcctgaggtctgaaggctgcatagcccgctgtgtctcaggacgttcacaaagctgccctcaccagaagcgtcgcgtccaccttcccactggaccaaatttttgattctgcccctgaaccctggatatgaaacccaatactgaagaattaaaatgtctcatctcacccggaggttcagttgtccttaaaatgcttttggattcatttggaataatttctatattggcttctttcatttaaatccaaatatagcttcagtatttctgacatatttattactttccagaatggaaatactagttcttctgaagtggtagctatttagttatagtcaattttgttagttatgtttatttgacttcaaattaagccagagaatatgcaaacactgcagtgtcttccacagccttaccaaaatgaataccatatttcatcaaatcaaaaatattgtcaactgtaagatgcaccattgtttcacatgagctaagaaagagtaagctattacatgacgcttttttatcacttggaattttattttgtgttcattgaagttcttttagcctgacttagacataactgtttaaaaatattttaacttttattataggtttaggggtacctatgcaggtttgttacgtaggtaaacttgtgacttgggggtttggtgtacagattatttagtcactagacactaagcatagtacctgatgtttgttttttttctgaacctctcccctcttcccaccctccaccctcaagtaggccccagtatctgttgttcccctctttctgtccatgtgttctctcattatttagctcgcatttataagtgagagcatgcagtatttggttttctgttcctgcattagtttgttgagaataatggcctccagctccatctatgttcctgcaaaggatgatctcattcttttttatggctgcatagtattccgtggtatgtgtaccacgttttctttatgtagttccagaaagttctcaggcgatgcccatgctgctggtttggggaccacacattcaatagctaggctttagtgtgtctaaggacatagtatgtcactgaagaaattcagtacctctccagggtacatggatgttttaatttttcttccatttgtattattattttgatgaaaatgtatatattgcaaatttgtttgccttgcattgggtaaatgcaaaggaagaaagcaggaattttgtatgtctgatcttatggtacagggagagagatttttttccccttaatttgtttcatgaaagatttgttcatttccttttcctttgctttctttatccaacttgggaaacttgaatttattaggaaatctgcatgtaattgcagattaataacctacccattaataccacattagttcatcatgattaatagcatctatgtgaatacttaatgaatttgtaatgatggactatttgctttaaagcgtcaagagaacattccatgtaaaaaggcactacccgtaacaggaaaattaattatatgctggttggataatagcttgtcacaaagaagatatgtttgtttggaaagcctcattggtattgatatttgcagtgagaggtactttttttaaaacattcatgaaccttttaatttgtaaaatgagaaggaaattttattttcatgaacagttaaaataggtgtagggactgatatttatgaaagagagcagcacaaacacaaatatgtgctaatatactcataagtttacctatgtcactaggcagaaagacttcctatagtggccatttagattaagttccgaattgaactgcttctactacccactggtctatcctaaattcacaagttcacttctttaaggctcaagcattttttttttcttttgagacagagtcttgctctttcaccaggctggagtgctgtggcatgatctcggctcactgcaagctccgactccctggttcaagcgattctcctgcctcagcctcccaagtagctgggattacaggcatgtgccaccacgcccagataatttttgtatttttagtagagatggggtttcactatgttggccaggatggtcttgaactcctgacctcgtgatccgcctgcctcggcctcccaaattgctgggattacagacgtgagccaccgcgcccggccggcccaagcatttcttgatactcattttatttcttcagagaatcatttgttttctctactgtcttcactctaattctgtgatgtcagcagtcatcattgtttatttctgtctttgccctatatctgaggaagtgaaggtcaagaagattatgtgacttgcccaaaccaatccagccatataatttgttcgccacagattatgggtctctcatttcaaatgtctccagttttaaccccggcggaaagagttgcaagcgcagagactctgtccagctggtgcctttgaggaaacccaagaagcccagtgtgattggagctctgagttggaagggaagaggcataaatgataaaactgaggagaaaggcgggggccagagcatacaggctttgtaggccgtgtaaagattttagactctatcctagggcaatgggaaggcgtttgtaaatgtcatgttgagggatgtaatgagcgatatgttttgccagagcttgctgctgtctgtggagagtggcttggaggaggtagctgacaaatggcgaccaattcatgctttacaggccccatcatgttgatctattttctagtctggtatccaaacgaaggtggagtttgacttccttgttacagaaaataccaaggcatgattgtttatccttttctctattttctccttaggtcaacatgaaagatcattgcttcttctttgttgcccttgatttctttgaacttaggaaggtattttgtcaagcacccccactcatggggcaaaatctgccagggaagtcatggcagctactggtgggcatggtagttagtactcgttctaccagcacttttgcccctttgggttcactgcttgtgccaaaggtgctgttgcttccccccttttgggggagaggattctggatagagaaggaaagaaagccttacccctaatcactcactgtcggaaacccagttctggaggagcagtctccctcgaccacacattgtggtttgaacagccaggaatagaacccctccttctctcacctcctcatagaaggtgggagtgaaaacaggggttagttgggaagtggctttttaaacctatgtttacagtgttttgatgtcactttcatagacgagggaggaattgtctgaagctcagattttttaggatttcagggatgtgatgtttatctctctcttcctctcttgaggatgtggtataaactggaattgaaaatagatacccggctgggcgtggtggctcatgcatgtaatcccaacacgttgggaggttgaggtgggtggattgcttgagcccaggagttcaagaccagcctgggcagtatggcgaaacctcatctctactaaaaataaaaattaaccaggcactgaggcacatgcctgtggtcccagctactcagaaggctaaggcaggagaattgcttgagcccaagaggcggaagttgcagtgagccaagatcgcgccactgcactccagcccaggcaacagagtgaggccctgtctcgaaaaaaaaaaaaagaaagaaataccctgtatggtattctttctttcactttgagagtctttctggcatagtgctaatatttttttccactcttgaatctgtgaatcaaccctcacatcaaacccctattgcattttatgtttaagaagggaactttttaaagctgaggttggcagaactgagaaacttagacctaaatgggcctatgcaaggagggtgtttccaaaacaaaacaaagtgtttagtgtcctccttgaagaatgttgacactgagttaaaatggagctgcagagtgaggaaatcagtaaagacaggacaaaagttccttttttgatttgaggtagggtaggaaaggcagaggtgggattctgggctggtgatgtttccagggattgcaggcatcaagaaagaccggtgagtgctgttggtttaaagtagttgttctcaaagtgtattcccccgatctgcagcatcaacattacctggcagtttgttagtaatgcaaaatcctgggtcccaccccagacctactgaattagacactcaagttaaaacacagccatttgtgttttaacaagctcccattttttttttttttttaaatttttgagacggagtttcactcttgttgcctaggctggagtgcaatggcacggtcttggctcactgcaacctcaaccttccaggttcaagtgattctcctgactcagcctcccgagtagctaggattacaggcatccaccaccatgcccagctaattttttttttgtaattttagtagagatggggttttaccatgttggccaggctggtctcgaactcctgacctcaggtgatccgcctgcctctacctcccacagtgccgagattacaggcgtgagccaccgcgcctggcctaacaagctctctttattattccaatgttcactcaagtttagaaaccactggcttagactagagcaaaatgtgaggtcaagccttgaggaccagccaactttgttctgttctaacctcaccaggcctcctacctctggttaggtgccccaggagtctgtgtccctggtcaaaaatagggtgacagggcaaagggagtagatggctcatcacaaagacattgcaccactgcaaaaagaagttatgatgtaaccagggaaggtctttccttcagttatggtggagagatctgtcagggaattccatgagggcatagctgcctctcatttagccactgggggcccattctctcacaggaaagcaacttgcagaatttttctgggtatctgatgtttgaattaacaggagtcagagacctgagtccaaatcctagctctaacctttactaactgagtctccttggacaagttcttatagttttcttgcctgcacaatggagttatgatatatgtttcttaggattgctgggcaggttaattgaggttatgtattaatacaatacatctggcacagagcaggtgcttaaaaaatgaacactgtcgttactggtccttggatgtcttaggattgttcaggaacgaccattgcagggagtatataaacatacacggctttttccttgtaacgttaagatggataaaataggaggcagaggccaggtgtgctggctcacatctgtaaccccagcactttgggaggccgaggcaggcagatcacttgaggtcaggagtttgagaccagcctggccaatgtggtgaaaccccgactctactaaaaacatacaaaaaaattagctgggcgtggtagcacgtgcctgtaatcccagctattcatgagggtgaggcaaagaatcgcttgaacccgggaggcagaggttgcagtgagctgagatcatgccactgcactccagcctgggtgacagagtgagactgtctcaaataggagggagaaaaaatataaataattagagttagtagtaaaaatgctatacgaaaaaactgaggatagatttattttaaacctcaagtttggcacagaccttacatggaattatctgctaagatacaaaatatctaaataggaaagctatttatattgagttaaaacataagattggcagattcattgtaatgctatgctatcaaagaataatgctaaaattgaaattattttgaagtataaccttgataataagtataattcttataaattcacttataagtgaacataataaaagagttatcttctgttagagttttgtagtatctggcaattttatataattaatttcattatggacaaggaggtcttttgtgttaacagggacatttttgtgttatttggtaacccatgatttagaatgatttagaggattttaatccccttaaaatcatctctgcacctttttcttaagctgatgctaaccaacaattatcatttataagatcataaaaaatgaacagagaaaataattctgacagcttctatccctatatttaggtgggagttttctagaggaatgagaaagatcagctcctattggcttttcagtatgtcatacagattcagttaatcccatgcttgactggccgtgaggctgaggaactgccaagctgagtgtcacacaattcgtgtgaaaatatatgagagttacgggatccacggaccatgacttagttaacttgaattttattttttaatgagaataacaataagctttgcaagcttatttagagtctgcagctttaagtgcataagggtttaatacctttaatacccatgcagtgtgagttagaaaaatgaaaattttcagtatagtaaataaactgaggagcctggaaaccaaattgaaatctgtagcctagaaaatcaacaagagctaaaaatagtaggattagaggcagcattcaaccatagaccatccaaaggtagtttttaagtaccaccaaaggagaaagcaggccattctataataagttttaaaaaaaatctaggtctagagaacattctgttcattatgtagatgtggaagcttaaagtatagatttggttttccagagttttaatttttcatgttctttttttcaccagaatcagagggcactccctctgatttccaaaagagaaatgttaccacaatctgcatgaaattgagaatttaccttgctgacactgacgtgaagattttagaatgcagttgctggccaggtgtagtggctcatgcctgtaatcccagcactatgggaggctgagttaggaggatcacttgagactaggaattgaagaccagcctgggcaatatagcgagaccccatctctacaaaaataaaaataaaacaattagccacggtgtggtggtgtgcacctgtagtcctagctacttgggaggctgaggtgagaggatggcttgggcccaggaggttgaggattcagtgagctgtgattatgcctctgttctccagtctgggtgacagcacaagaccctgtctctaaaagtacccattaagcaaatcaagcaagtggctccaggattcactggtctcttagcaaagagccagaggccccctttcagaataggcacatggaaatattgcagggtcaggagaaagaacccaaaggagggtgtttttaagtgttcctgtgctcctgagccacttcattcaaatgtcagctcaatcaaggttcttggtaggtttttgctcataggcctaaaactttgcatgtgtggagtttttgaaaaatgttttaggtggatatgtcttagatattgtagaaactttaaatgattggcctgagctgcagatggctgttatgaactcttgactaagcatggtactgtaaaatcctcaagggcctcatccttcctttggaatttcctttttgtattctagagcactcaataaatgtcctgtctgagcagcagaattgaattgagtgaggattgatagtcctctctcagcttccgagcagaactaagtattttttttctccccagtgtagaagagcagggcattgggaatggatgataaagctgagacaattgatgaaaataaaacttaggtacccttaaaactggcgttcatgaaaacagatgaatgaagtcttggatttcattgtatgatatagggactgagatgtgaaaaaaagagatggtgttgttagtatgatcagggcattgctgattgtaaaaagaaataataaaagtagtcagtccagcttctcatagttctttttcaattggatgaaagtctctctcagactttccttgtcaggaattcaactcagcgaacattcactaagcaccagccatgccaagctctgggtcctgggtgttcaaagatgaatgtgacccagcccctgcccaaaagagtattcaatctaatggagcatagccattgttaatgccaatgttttataccaaaagtatttcttggtgatattatttgaggcccaatgaccaaaaatatctttattattaaaattctcacgtttcatcccctttgaggctaggcttgggttacaaaggcatggttgtccacaccatggtcaaaaacaaattttagatggactgtagatctaaatgtgaaacaataaagattttagaagaaaatgtaaactgtcaccgggcgcggtggctcatgcctgtaatcccagcactttgggaggccgaggcgggtggatcacctgaggtcaggagttcgagatcagcctgaccaacatggtgaaaccccgtctctactaaaaatacaggctgggcgcggtggctcatgcctgtaatcccagcactttgggaggctgaggcgggtggatcacctgaagtcaggagttcgagaccagcctggctaacatggtgaaaccccacctctactaataatacaaaaagttagctgggcatggtggcgcatgcctgtagtctcagctacttgtgaggatgagtcaggagaatcgcttgaacctgggaggcggaggttgcagtgagctgagatcctgccactgcactccagcctggcgacagagcgagactccatctcaaaacaaacaaacacacaaaaacaaaaaacaaaaaatagctgggcatggtgacatgtgtctgtaatcccagctacttgagaggctgaggtaggagaatcgcgtgaacctgggaggtggagattgccgtgagccgagatcaagccactgcactccagcctgggcggtagagcaagactccatctcaaaaaaaaagaaaaataaaataaaatgtagactatcttcatgagtttgggataggcagagatttcttgaacgggacactaaatatggtaaccatggaggagaaaaatggagaagctgaactaaaataatttcagtttattacaagataccattaaaaatgaagtctatgtaatgggatattttataatatattcaaaaaggactcgtacgtagaatatagaaagcacttctacaaatcaataacaaaaaggtagattgctctataaatatgtgatatagacttgaataagtattttaccatagaggatgttaattttcttgcttggggttagtgattggaagggagcacaaggggcttttggggttccagtaataatgctggttacttgagcgtgttaactttgtgaacattcttcacattatgatctgtgtacttttctgtatgttgtattatttgtgtacttttctgtactttcattggaaaaatttacataaaaaaagaaaatgctttgctgtccaggatgaagaatgtgagcagaatatttttggaggttaacactgattgcaaaatatgtcttcccatttagaattgcctctactatagaagcagaggaaatgttgagagcatggggctttgcaaggtggctatagcaggtgcagtttgtgaaatagtcctacacacagcctggcagtgtcttaggttagcataagtcctttggccaacaatatcctgagaagcaagcaggagaacaaacacagttatggaggaagcactagaaacaagcttgattacttgacagttttgtatagggcgaattctgcctgtaatcctgtttaagtcaccacttactgatccccgttatcatgtgcccaggcaccaagatgggggctttctgtgtattaaaaattttaaatcctcagcacaatcctgggaagcatgtactattattatttgactttacagataaagaaactggggcttagagggattaaataactcgctcgaattccagctagcaagttgcagcaagctgcaactggaacccatgtctgtgtgattccaaagcacccccttcccacatgtctattatgttgcctttaaaaaaaagttatttgatggagcatagtgagaagaaaaatacttaatatgtacttaatgttcaaatttgatgatcagaagaacttctcaaaccacttttaaagtctgaggtttgctgtgctatagtttttttttttttttttttttttttttggaaacacactttgtcgcccacgctggagtgtagtggcgagatcttggctcactgcaacctctgcctcctgggttcaagcgattctcctgcctcagcctcccgagtagctgggactacaggtgtgcgccaccatacccggctaatttttgtattattagtagaggtggggtttcaccacattggccaggctggtctcaaactcctgaccttgtgatctgcccgcctcggcctcccaaagtgctgggattgcaggcatgagccaccgcgcctggcctgcagttttatgaactgctattgtcctttgcagttgtaaggtggtaagaaatacctgggtggggtggaggtggggattgagaaatcctccaagaaacaacacaggctatgattggaatgcccctgtatgggtgacccatgagcctttctcaatgctttggggacattttaataacctgagtaattacctgtggtacgcaggctttgttttctactcattaataactctccaggctacattttattcttcttactgctaattcacatgcagagatacataaaatggatgctgtcaactgattgccacatcactgtctgcatatcaatgctctcctgtctgcttgggctcagagagaaggaaagaagagaaggaaaagggtatggcaaggaacttgtgatagccgaatctgttttaaaagccaaattctggtacagaaaccagaattttgacatatacaaattattgatatttgtgcatggttagtgttttgggattgccctatttagcatctgctgatcctctttttccctccctgtgatagatagcatgccttggaagcagacacaggtaaatatttaatgcttttagttttttttgctcctgtggcttgtttggcccttagggcattcatgttttttagcctgtggagtgcttatagcatcagaacatcatcacaaccctaaatgaaatttggattatttacttctaagtatgtttcccaaatagtctaatgactgtgtaagcaatatagtggaagggtacaggagccgatttgaatggaaatatatgtggatatggctttagatctttctgcgtattaaaaaaaaatctcctttaaaaaatccttggggacctggcacggtggcagtggctcatgcctgtaatcccagcactttgggaggccaaggcaggtggatcacctgaggtcaggcgtttgagaccagcctggccgacatggtgaaactccatctctactaaaaatacaaaaaattagccgagtgtggtggtgtgcacctgtaatctcagctactcgggaggctgagacaggagaattgcttgaacacgggaggcagaggctgcagtgagctgagatcctgccactgcactccagcttgggtgacagagtgatactctgtttcaaaaaaaaaaaaaaatccttggggctagttatcttgattttattattatgatgatacacaagaaagaaaacaccaaacaagctgaaataattgaaaatactcacatccaacccaatttaatttatttcactggaatctatctagttatatggacttgttttaggtacaggtacttatttttaaaaaactagacaggagctctgggttgctttttttttttttttttttttgaactgtagaacttctggtttagaagtaagattcctcttcaggagatatacaattatttattaacttaattagtgccgtacattttgtcttgaagctattcagagtattataggaacatctgttgtactgtgattatgatggctgctaggctgtttccccaaatgccttgacaaggcagtttgacatagttcggtgaaggcagtgccctggtgctgcagtcaccatagggatttttcatcttggcttcatgttggtagattgatactctcaagtacgttcaaggttctctttttcgggagagggttgttttcattgagtcctggctttcctctttccttatttaatgaaatagtgacaactatcattttctaccttcaaacattattattagtgattttataaatagaaaattattttccaggtgggcctatgtctgtgctggcaaccattgtgtacacacggactctcttagatgtttaggactttgcatgtgtaaacgggcaagttttcaggcaattcgggtaggttttccaatcttgtctttccatttcctgtctaaagaacttcttccatgtccacagcatgtttattcaacaatggataaaacttctaatgggaaatttcttccgggtgacctccttgagaggctgggctgtggagaaatcttaagaaacacaaccctgatgaaattggctccgttgagaatattacttggtccaggaacaagggacagaattcagttatttttggttcttgaataaatgaattctgtttccttttgtgtaggtggcagaagaaattaacccctgtagaacatccattctcagttggaaattaaatttttggtttcttttgagttaggagtaccctggataagagaatgtaaaactgtttttatttgaacctcatgcaacttggaatctgttctgttgtctgcatatctttgatagatttgtcttttccagggttgtctgtctttgtatttaattttctggaggttggaattgtgattatcaaatgacttccaacttggcaccatatgtgggtggatactaatgaatcctttcttaaccttcccagaacttttggagaaatcaatcagtagaaggcgggacaccgaagccatacagaaagccaaaatcctttattcatcctgcatgaatgagagtgagtgatgaagaaaactaaataaaatatttaccatccctatcctttagagttctattaatgttttaatatattgtttgaggaagaagagaactactaagaattctattaatgtttaaaggtgttaaaggaatgattgtgaaagactggattttgactagtcccatcttagttaatgttgttactggcttggtggagaaaatcttatttatatgagttggattctttgggtatcatttactccctgagaaacttagacaaagtcagcagggcaaactccactgtatctggtagagaatccagaagccaggccaagtctggcttgagacagagactgggagggagtgcacctactggagcctagagaaatccagattcccaggcatgccaggttcctgtgtcagcctaacaggcatctttgttgggtccttagccctgtctcaatatcttgggtctgattggaatcagaacagatactggccacttgacctggtctgccttctcaagcccaccacaggaagaagccagtgcctgtgggaagtgtgtcaactggtctaggatttggggtatcatgtggtgagctagaaaagagcaataaaagacaggaatctgaagcatcacttcttcttcattgggtagtgattggctttattgaggcattcctttagttagggttgtaacttagtcccaccaagtattattcattggctgggttccatgtagagaatccatgtttattgtagtgaatatccagcagtttccctggtcagctctcctggcaagaacactaggtatagacagtcacattgaagcgtggatcgtaggtagttctgtctctgtgattatgctcatcccaccccacctcttttacctactccctaacagctgaaattttaagttggagcattatgggaattttgtcttgagaagatgcacttaaattctagtgtgctgatccagtttgcaattctaactttctcttcatatctgctccctttcagaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaaggtataatgaggacccattcatcttctttgctcagtcctagattagccttttggggtgccatcctggggaaagagactcatgctgccttagtgaaataataacataaaacacttttattgaatagtagaatccagaatattcccttctcccggctttgcagaatgtagaccattaccatacaagttttgtaagccttttggaaaactagtgaattagtttcaagtgatctgtgatctggccctcatatgcctactcagagcaagcctagggttcctaaattccagtgggaaggggactgcaggtctcctgttgttagcagagattttctgagccctgctcttgtccttgcctcctcactcccttgatagaggagaaaacacgtgccatgattttttgttcctctttcactaacattttcttgtgcacacacctaaattttagttatcaacttcactctgaatctctcctccctcctttccaaagatacagcaaaacttgttctgttccaagtgcttggttgcgttttctgttggaagactaaccatgtctcccataaagcaatgggccacatggacataccctgaggcatttcacactggtaaaatcaggaggctgtcagaaaactaccaacagctaaagactcaccaatgaaagagctatgcaagaattcaaataacattcgtcaaatagttttgtgctttgatcctgctgggttttgttttgttttgcttccacagttactttgactaataatgaaaatgttattgcatgactgattttctccccaattctgtccttagtcaaatcagaaaatattaatgaaatattgatattcaaattgtagacatgtattgccctcacctcatgcattttaaccttctaaaatccaaatcttaaagttcatcgtttgattgaagctggtcatcgtttgatcagagattggcacattttttgggtaaagggccagataatacatattttagggtttgcaggccgtctggtctctgttgcaactacttaattctgccattgtgtctgggaaagcaactgcagacaacaaaggtatggctgtatggcgggctggcccagtggctgtagttttctcacctctaggttagacaatggaattctcagtaaaaatctttggtcattgaaaggactcccctctactcaggaggaaattctgagttccagagacaactgtgtttctatgtttggtgatgaaatgagccatcttctaatgctatcaggataagatgtgctatgtaagacacaatgatgatgacgacccaactgatctctgtactgtgttgatatatcactcattttttgaaactaggttttaagactatcattatcagttccagaactattatgatgttctttcaaacaccttaagttggtgttttgaagtaagctgaaggctgttttccaaacttaagtttaagtttatacattctattgagtgatagaagatcttgattcacacacagatgaataattgcaaacggtagccattttattatctttctcacctatttctggatctattcaattgaatttattgctttaaactttttattattaaaatgtggtacaaaattaaagaatagaaaaataaactcccatgtatccatcaacccagcttcaacaactctcaaccttctgatgttatgtttctttctgcagttatgttttaatctagagccctccttttttgggaggtggctagaacattttatagcaaattaaaaatatatcattgcatagtaaatacttcagtgcttagctagtggaaaggactattatcacaaccaaaaagataatcataattccataattaacatctaataactagttaattttcaatttttctgattgtcttaaacatgtccttaaaaaaaaaaacagttggtctttgattcaatctccaaataaaaatcacaggtgaacttagttgatatgtctgttttactccacaagggatccccctatttttgttttttaaaccacatttatttgttgaagaaactggagtatttgtcctgtaaactgtcttacattctgaatttgactgttttcagggtaatctaatagctgatgaaagttcttgtttataggagaatcacagcttaaaaatgcagaagaaataataggaagctatctatttaaaaaaaaatccctaaggaaaggattgatctaggcaattatcatcaatggctgctaaaaccattaggtaaatggttgattgggaaattcatgatatcagaccgatatcacctgaaccctaatatcaatgatagcattgctaaaagtggggcaaccagatattgtgtgcctcctggtatcagtaggaagtgcacactatcaccagtgatgttgtcgtgcccccacaattgagcctctagttttaagaggagcttacagaaaacatggggaatagagaaacatggtaaccaatttttaatagcttgccttgtatacttaatattcaattaaactgatcctagaaacactaaaatgtcaatgatagaatactttccaaatgtaaggaggcacccatgtacttattattgctctcttttgtcaagatggcagcttgttccaaactggtgtttgaacattgtttggcatttgagtgcggcaaacgtttgcttaagttctgttcctgtttgtacctttttccatgactgaatattcacacatctgaactaattgccttccctcagatataatataattatagtcttcctgatgacacatttacaagagttcgagcatgtatctggaggtggtaggagaagttttattctgagagctgcatgaaacccattgaacctgataacaaaaattagcgtactggtggctgccaaagttgtagaatttgcaagtgttgcttttttattcatttaaaaatagttaaaactataaaagacaaaatctaattggatgaacatttgaagccccccccacttataggttttgtggaacatagtttgaaaactactggtatagttaaaaaacaaacaaaaaaaataataggctttggtatttaaaagattgaggtttgcagtttagctttgtgatgtactcaccgaatatcctcgtgcaaattacttcacctcgctgatttcacttttcccatgtgtacggaagggtgaattagaatttacttttaatcgtcattgacgttcaaatgaattgacttttgtgacagttttcactgtagatactggtccacagtagcacacgacacaaggttccgaacctactcttcaagcatgacccagcaactggtcaggaccatttggagaatgtttttctttgacatgtggtacccgatatgcctctcagagctcaaactcagtagtgcaaggaataggaattttgtttactcaacctaatatttgacttttagctcccacccaaccttttggtgggaaactgaaccttagtctaggcatttacctcccctcttggtggccccatttctcggtcttttcctagggtattgggaaactgcaataaccagttatctggtttctgagaagaaacccactatggaaccatgtagcctcttcaagtgtgcccctctgatgctgaggtcctgcgactcccattccttctcagatcctgccatgttttggggtgatcagttcctctgctcatgagaattcttgacttcttttgctgcttgaaagatcctctttctgctctgggagaaatccctcttacctgaaactctcttccctcaatgtcgttaggcttccttttccatcgaattcaattttcttcggtgtgcttagcttttctaatcccacaaacccacaggaataagagaagggccttttgggcaggcacagcactgtgggcatccttttgggtgagcagatggtgcctttgggtgaagagacaggcaccctttctaagggttagatatatccccatgccaaagacatgcagtttggccagcaggggtcgctctaatctacacagcgtacttctgcaaagctcccctgtggcaaaatgatacagggtttgctacaggcttaaatgaggtaaaggaattccaaaaataaagaaaacaacagaagttagtgaccaaaaacattatcttgctgcacacgtttggatttattctatgtcaggagatagtatgaggatttaagggacaataaaagacgtgagtatatgtgatcctgaaagagtatttggaaggccaaggatgtcccagtatgtattactagttaatgaagacaacaacttaaagtcatcatctcacaacagcctgcatttttctggctctcagcaaaactcgtaaaaaatggcaaggagaaactccaagaaaatttgaaaagtttcattctctttccttttcctttttttctcaggaactgacagaacatagaattttattttattattgttattttttattgatacgtaactacacattttcatggtacatgtgataatctgatacattcatataatcaaatcatggtaactgggatatatccaataatgggattgctgggtcaaatggtagttctgttttaagttttttcagaaatcaccaaactgctttccacagtggctggactaatttacattcccaccagcagtgtataagagtttctttttccttatatccatgccaacatctattatttattgactttttgataataaccattctgactggtgtgagatggtatctcattgtggctttgattcacatttctctaccgattagtgatggtgagctttttttcatatgcttgttggtcacacgtatgtcttcttttgaaaagtgtctgtttatgtcctttgtctactttttaatggggttgtttggtttttgcttataaatttgtttatgttccttgtaaattctggatattagacctttgtcggatgcacagtttccaaatactttctgccgttctgtgggttgtctgtttattctgttgatagcttcttttgctgtgcagaagctctttggtttaattaagtcccgtttgtcattttttgtttttgttgcaattgttttgggcatcttcatcatggaatcttgcccaaagtaatttacagattcaatgctatttctatcaaactaccaatgacattgttcacagaattagaaaaaggctattctaaaattcatatggaatcaaaacagagcccgaatagccaaagcaatcctaagcaaaaagaacaaagctggaggcatcacattacccgatttcaaactatagtataaggctgtagtaacaaaaacagtgtggccggtacaactacggatacatagatcaatggaagcagcccagaaataaagctgcacaccaacaaccatctgatctttgataaagtctacaaaaacaagcaatgggtaaaggactgtggtgctgggataactggctagccatatgcagaagattgaaactggacccatcccttttatcatatacaaaaatcaactcaagatggattaaagatgtaaatgtaaaacctaaaactgtgaaaacccttgaagaaaacctaggaaataccattccagacataggccctgtactatattttgaagtcaggtaatgtgattctccagctttgttatttttgcccaggatcgctttggctatttggggtctttcgtggttccatataaaatttaggatttgttttttctattttgtgaggaatgtcaatggtattttgatagaggttgtgttgaatctgtaaattgctttcagtggtattgtcattttaacaatattctactaattcataagcatggagtatccttccatttttttgtgtccttttcaacttctttcatcaacattttatagttttctttacatgaatcttttatttcatgggttaaattgattcctaggtgttttatattgtaaatgatattgtttattgatttctttttcagattatttgcttttggtgtatacaatgctgttgattttgtatactcgaactttactacatttgttgatcagttctaatagttttttggtagagcctttaggtttatccaaatataagatcatgttatctctgtacaaggctaatttgacttcttcctttccagtttggatgccctttatttatttctcttgcctaattgctctggccaggacttctagtattgcgctgaataaaagaggacaaaacaggcatccttgtcttgttctacatcttaaaagaaaggcttttaatttttcaccattcggtatgatgttggttatgtgtttgtcagatatggcttttactttttgaggtgtgttccttctgtacccagtttgttgagggtttttgtcataaagggatgttgaattttattgaatgcttttacagaatgtattagaatgattatgtgatttttgttcctggttctgttaatgtgatgtgtttatatttatgtacttgaatttggattttccatttaatttattttttttgagatgggatctcactatgctgcccaggctggacttgggttcaagtgatcatctagcctcagcctcctgagtagctggtactacaggtgcatgccactgcacccagcatatcatgtctattgatttgtgtatgttgaactatcctggcatccctggattaatcccactcaatcatagtgaatgatctttttcatgtattgttgaattaggttagctagtattttgttgataatttttgcatctatgttcctaagtcatattggctggtagttttcttttctccttgtgtccttgtgcagttttggtatcggggtaatgctggactcatagaatgagtttggaagtattcccttctcttcagtttttttttttttttttttggaagagtttgaatataatttgtattgcttctttaaatgttttgtagaatttggtagtgaagacatcaagtcctgggcttttctttgatgggagaccttttattatggcttcaatcttgctactaggtattagtttgttgaggttttctacttcttcatggttcaatgttggtaggttgcatatgtccaggaatttattcatttcttctagatgttccactttgttggcatatagctgttcataatagtctttataattctttgtatttctgtggtctcagttgtgtcttctttttcatttctgattttatttatttgtgtcttctctcttttattgttagtctagctaaagatttgttgattttcaaaaaaaaagccaacttttttcattaattttttttggtgtttttatagtctacatttcatttatttctattttaatctttattatctctgtctactaatttggggtttggtttgttcttatttttctagttccttgagttgtatcattagattgtttatgaattgttatttgaagtctttcaacctttttgatgtaggcttttattgctataaaattccttttcagtactcctttggctgtgtttcatagattttaatatgttgtaatttcattttcatttgtttaaagaaatttttaaatttcatttttatttttttcattgacccattggtcattcaggagcatattgtttaatttccacgtgtttggccaggcatggtggctcatgcctgtaatcccagcactatgggaggtcgaggcaggtggatcacctgaggtcaggggtttgagaccagcctgaccaacatggtgaaactctgtctctactaaaaatacaaaaattagccaggcatggtgtcgggtacctgtaatcccacctactcgggaggctgaggtgggagaattgcttgaacctgggaggtggaggttgcagtgagctgagatcatgccactgcactccagcctgggcaacaaagcgagactccatctcaaaaaaaaaaaaaaaaagattccatgtgtttgtgtattttccaagtttcctcttattattgatttttagttccattgtggtcagaaaagataactgatatgatttctgcttctttgaatttgtggagacttactttgtggcttaaaatatgatctatcctggagaatgttccacatggtgataaaaagaatatgtattctgcagcaattgggtgaaatgttctgtaaatgtcagttaggcctatttggcttagtgtctagtttaacgctgatgtttctttgttgattgtctagatgatctatccattagagtggagtgttgaagttccctatcattactgtattgcagtctccctctccctttagatctgttaatatttgctttatatacttaggtgctccagtgttgggtgcataggtatttataattgagataggcagtatattgctatatctccactaggtccttgcctttttttctggcactaaatggcaccttaagcctacgtttgctttgactctagcccaagatcagagcactcccagtccagatataggggaggtcctaaagaggatatcctggcagtgtggaaaagctggctggcggctagtgtacaggtgacctttggaatgaacctcctatagcataatgctgctgaacagccactctgatttggtgtctcctttggccgagttacggagcagagtttccagggctgggtatggtagtcccacctcccctctttgtctcttgctgtcttcagaaatatatctcccttcaggcactcatgatgccttctgtgggttaaggtatgggcaggtcttctgtcaaagaacccaagatggtcaggaagctggttgtccaccttgatctcactttttccagtgtagaaactatgagtcagggaaaatttctgcaggcttgttgctggacagattggttggaagggcatcatagagaaattttattatcctttgtctgcttggagttttttcacttctctgtggcctcagcaactgattcatccttatatttgagttctgggatattgctggtgagaatcttagtgctgtatatttgtttttagtttcctgtgtatatgttggggtggggagggaagccagcttctgtctccaccaccattttgaaacctgaagtccagactccatttcctacctcaaaatttgtaagctctttcttcttgtattactactttgtcttctaacttgaggtttattatcattggaatgccagttgtaattggagaaaacatttatattttcagttaaatgtgttggatttcctaaaaaacatactttattttctgcttacagtatttagatcagttgtaaatgcaaggatttaaaaaatctcaacgcagtgtcctgattgcttcatgagaaagtcttttgcctcaagagtttgtatgtttctaatgagatttatttgactgaccttattcaatttgttggttggtgtgtttaaaatgttccctagaaaccataacaatctgaaagtttataaaaggtctggtaacctcacttgaattatctaaacttttacaataagtggatttaactttatttcatgagagggaaactttggctttcttgataatatctacacagtttcctttcctatgagactcaagctcaaaagattcttcaagtggtccaaatttaattgaaagccaaagtgtcttaatcataatattgtgtttcatgatcgtggcttgcttaatttttggaagaaatagtggcagattgggaattgcagtaggacgaagccaggaaggcttgtgactttgttgtttcaggccaatgagagagggttgaacaaaataatttgaggattttagcagtatacacagacaagatgggtgttttgaaagtgccttttttcccctgaaacaagagttatgtttttcctggaatttttcataatatcactaattcttaacgtggcctttgtaaaatttgttgtatattaagggcagtttcatggaaaactgtaatcttatacaaatttatgtatttaagattatagtaagacgaaaaagaagctggaggagatgggtcaaaacagtttaaagtcatataaactaatggtatgggcatgtaggattcagtttttattcagatattactaatttttaatttgttgtttagattttgtttcttattattttggcttaatgtttaatgtgtgaattagagatttaatttggaaaaatctactcttcttgagattcattttatttatctttagtcagttgctgatattcaagaaagaacaaaccacagatttagagaaggtgctggaaatttttttaaagtatcttaaaatttacataaattcattttttgtgatgtacatgtctaagttttgacaaatgcatagagtcatgtaaccaccactgtaatcaagaaatagaatagtcccatcatccacccccaaatacctcatgttatccctttgctaagtcaagccctctcctcatgcccaaaccctgttagccatcactttgttccctgttcctgtaaagtttggctttttcaggatgtaagtaaaattcacccatgttgtatcagttcattctcttttattgttgagtagtattccattgtataccacagtttatgctttcatgaattggaggacatttgggttgtttccagttttgggtgatattgaataaaattacatacaggtttttgtgtgactttaaatttttttcctgggtaaatacctagaagtaggattgctggctcttgtgtaaatgtatgttgaactttataagaaactgtaaaattggtttccttccaaagtggctgtgccattttgcattcttaccagtaatacatgagtgatccaacttttccacgtccccaccagcagttgtcagatttttttttccattttaacagatctatggtagtgttttattgtgggtttaatttacattttcctaatgactaatgatgttgggcatattttcgtgttcttattttctatcttcatatgttctttgatgaagtgtctgttagaatcgtttgctcaattttaaattgagttgtttcttttcttatggttgagttttgaggaatctttatgtattctagatacacgtcctttgtcatatatgtgattttcagatattttccccattctgtggcttgtctttttattctgttaagtttctttcaagagcaaatttgttcaatgtcgataaagtctaatttattttttcttttaaggattgtgattttattgtcatgtctaaaaactctttgtctaacccctagtaacaaaaatttttcccaatattttttccagaagttttatagttttaggttttacatttagggctatgattcattttcagttaatttttgactaaggtgtgaggtatgtgtaaaggtttattttctttttgcttatggatgcccagtttttcttttctttgagatggagtcacactctgtcacccaggctggagtgcagtggcgccatcccagcttgctgcaacctccgcctcctgggttcaagtgattctcctgcctcagcttcccaagtagctagaattacaggtgcgtgccgccacacctggctcatttttgtatttttagtagagactgggttttaccgtgttggccaggctggccttgaattcctgacctcaagtgatctgcctgccttggcctcccaaagtgctgggattacaggcatgagccaccacacaaggcctggatgtccagtttttctaacacgctctttgaaaagactgtcttctttcttttgtttacctttaaggtgctgaaagttttttttgttttttttttgttttttttgtttttttttcctgagacagagttttgctctgttgcccaggctggagtgtagtggcgtgatctctgctcactgcagcctccatctcccaggttcaagcaattctcctgcctcagcctcctgagtagctgggattacagccacacgctaccatacctggctaatttttatattcttagtagagacggggtttcaccacgttggccagcctggtctcaaactcctgacctcaagtgacccacccaccttggcctcccaaagtgctgggattacaggtgtgagccaccacaccagcctaaggtgctgaaagttttaattcaagaatttatactatacttttctatcactgtaattctacttatttagttgtctggttattatttgtgtttttatcacttatcctaaaccttccagagagggttctaacatttgcgaaggtttctcaaaacaaaattattatttgattccattcaaataaaaaaaaatcaatgccatatgttattttagagataaggagttggaaacgtctgattaatcaactctatacagattggcattttgcaaaacactgcaatgagaaaaatactggaactggtgataggagacaacgattttagtctgagctctgcccaatcatgttaccttgggaaagtcacaacaattatctggcttttgtttctcctcccattgaataagggagaatagctaataatctctaagatctattccaactgaaatagccttgttgttattcagtgttgataggacctcaaaaggtttagaaaacataaattagaaaagcaggggcaggtctctgatagtttattatatctgtcattgccaaagtgcctatttgcatgtaattctgagtgtactgaattgtttttgtaatggtgacatgagctcaaaatatggctgggatgcagacgatttcatcactcttgttaacatggtacgtaagaatttacagtgctagcagaatgctttctgtttttgtttttacagctggaccaagcaacactctccctggccgtgagggaagactaccttgataacagtacagaagccaagtctgtaagttttactcatattcaactatgtgccttaccaggctgctgtcaggcccattagttctaaggccgctgcttctttattggaaatgagcagtgtggctattcaatgaccatattcccaatgcaggaagacttttattcaggcagataaattccactccctgtctttctagaagtctgctcatcaaggctgtacaagtctcagtactcaatgcccttatctagcttgggagacagcactcccaaatgaagtaacaaagaaatgagcttgcagtcattcattcctcagaagtgcagagagctcactatcaattgcagaaataaagcgtcagaagagatacccaggagacagatggttcccaaattgtactgctttagaatcacttgggaggctttcattaaatgttgcttcttgggtcacagccctggagagtctgacttagacttgaggtagggtctgagaatctatatttttaacaggtgttccaggttaatggaggtttaataagaatcagaaaggatcaatcaagttagacttcttggattggcttagaaatctagcagtctcctggatattggaaagagctggttcatttctgacactttcaatttattttggaaactttattgaacttccaaaggagcctcagacctaggtcccctgggtctatgccgatactaacttctatacatagaaggctctggagggaagctaactaagatgctgggcagctttcttgctgaggacactcaccaaagagggttggcaagttttccttcctaaaagtggacagaatgaacatttgccaatgtggggggagggtgtacccctggtattgatggagtctcagcaaccaggctcaaaatcgtctccccctataacctatctgtcaagtcctaatgattctaccttcaaaatatctcttccatccacttggtccctcttttctatcctgactgctataggtcagattcttgttaactcttgccttgactacagcaagtagccttttaactgttactgcttctccttcatcacattgcctccttagcaccagttgacaagttctgttctcaaagcactgctcctagcatgccttcgctcccaagacagggtctaaattctttagagggctttcaaggctgcctcatgactttatcccaagtcatctttcctatctcatctggatttgttcttcccccaacaaaagcagcttgcccactgtattagtccattctttttctcctaataaagacatacctgagacttggtgatttataaaggaaagaggtttaatggactcacagttccatgtggctggggaggcctcacaatcgtggcagaaggtgaatgaggagcaaagtcacgtcttacatggtgtcaggcaagagagcttgtgcaggggaactcccatttataaagccatcagatctcatgagacttactcactaccatgagaatatgtgggggaaaccacccccatgattcaattatatccacctggccctacccttgacatgtggggattattacaattcaaggtgagatttgggtggggacacagccaaaccatatcacccacctcacaggacccttcactgcgttggaaccagtctccctcaaatgctatgtccccagtttctccgggctagatttttctctcagatcttcagtttccaagcgtgtagcagctttattaaggaagttattttgatgtctttaatgttacagttcataattacatgtttatctccctcactgtttgggaaccagacacagcattattattttttttctgtaccaccctctcctaacatatgcacagagggcctaccaagccaccttgtacatttgagtaggtactcaataaatatgttttttggtttttctttttagatagagtctcactgtgttgcccctgctgaagtgcggtggcacaatctcgactcattgcaacctctgcctcctggattcaagtgattctcccacctcagcctcccgagtagctgggattatgggcatgcaccaccatgccgggctaatttttgtatttttagtagagacagggtttcaccatgttggccaggctggtcccaaactcctggcctcaagtgatctgcccacctcggcctcccaaaatgttggaattacaagtgtgagccaccacctccggccaataaatatgttttgaattgaattaggaatagcaaaatattatttctatttaagacttcttttcttttctttctttcttttttttttttttttttgagatggaatttccctctgttgcccaggctggaatgcagtggcataatctcggctcactgcaacctccgcctcctgggttcaagcgattctgctacctcagcctcccgaatagctgagactacaggcgtgcgccaccacgcccagctagtttttttgtatttttagtagagacggggtttcaccatgttggccaggctggtcttgaactcctgacctcgtgatccacctgcctcagcctcccaaagtgctgtgatttcaggcgtgagccaccacgcccagcctatttaagactcttttcaaagcttgcttactgattcaacaaagatttattaaaggcctcctgtatgctaagtactgtataggtcctaaggtcatacatatagtaagaatagcttacagagtcaaggtataagttagtaaatcttattcccaatgcatgagaaggaggtcatttaatacctgatgcgttgagatctcacaaatatatctgaaatgagaggtgggcctaaggcagttctttaattcccattaagtaaggtcacccctgccccacccaatgacatatgattatccccaaaatgggtttatgagtatgtaagaaggaaattctatatttgctatttgttaggtttcctatcatcgttcctctcttttctcctttttttcctgagctagggagcaggactttgtgaaaactgtaaaaacctgaaaagacacagggctgctgtcactggtcttttatttcttagtgtgaaggtgggtaaattgagttgcaagagaataaatcacacctcccaccattctttatggatcaggcctcctgcttttagaaacagttctttcccattgttttattaaagcctcacttgtctggaaagaggaagtctgacctttaactttctattcttgtctcatttggagttatttcatgtatccataatatcgacggttgccagaaaactagttctcttgttgcttgatggctggacatctctgtctgtcatggaaacagtactcaagtagccgtcactctttttttctcccaaagtgttatatgggtgcctggtattgcataatgcctgcaccatactttgagtacagagtgaaaataaaagacatttatttctacctgctattttctgctcttccatgtctctcaaacatatttcctaagaagctattgtcatggtcactttgttctttatttcttacagtatcgggatgccctttacaagttcatggtggatactgccgtgcttttaggagctaacagttccagagcagagcatgacatgaagtcagtgctcagattggaaattaagatagctgaggtaagtcttcactgaaaatctctttctttcctttactttcttttcttttcctttactttcttttcctttccttttattaaaggcagtatatcctgaatgaaaatataaattgcaaacaaataatagcgttttgtgtcattgcccattgggcccaaggtagaactaatagcatcccctctaggaagtaacaaggactgtgacagaaaagctcctcattccttccacctccctggtttaagcccattcagtgtccatacgttgctcagctgtggccaaagaatagcagcagagagaccctctgaccgtttttcctggagaaactcatgtttggcttaaatagaagatagatgtttaataaatccttagtaatctggcttgaatggaaggttgcttttaatccagcccatgttttatgctatccccactcagagtcattctggcttaagttctgggctcagggaaatctgtccaccaatactggatataaaagttggtatagaaataggtaggacatgctggtaagcatttttaaacgacctttctggtattactttgtacctgcccctgtttttcattattttcttgccctactttaatgaatatcattgtgtcatatacatgacacagaactacatgtctatgtaaattaccttaacttcttgttggctcattgtagagacaaaaagatgtaaaaacaaacttgtgggcaaaataatgagaactcctaaatggttagctttgtttatggaataacttttttctagaagaaagaaagtgtaaaaatctctctatatgttcctaggccaagagggaataaatgtggtaaaatctgcttctggggaaaccctgtagtgaaaaaaatgatactttttaccaagaaagttttgcgtatgtgttgggaatcttttacaagagaagttggtaaaaatctcgagatgaataagagtccaaatgttgattggttttgtttggcgaggtggtggtggtgtgttgaggtatggagtagggatgaaggataagggtaaggaggaattggtctctctctctttgccgtggtgatgttcgtgtatagctctctccaaactcctacttgcagtgcaaaaagttcattcctgcatgtcacctttgaagactgtgaagactgctgcagatgtttcgaagtccaggactgtgcctctgagccatgtctagagtctgtctgaattctctttccaggcacataggaggcccagggctctcatttggactaaaactctgaaacagcagggaaggccttgccctgagccagggatttggaccaaaaagggaactaaaaacagctgggctgaggcaagactgggaattgtcaaaaggctaaatgaagtgacaaatctattgtgtggaggggagtggctggcagagagctgaaaacagctctgaggccaaagggctccaacttggggctgtgagactccgagggcggaggagggattggtggaagaggagtgtggatatcctctgaggcaatgattcacaccgagccaggaggctgtttgtaagttacatgtggtctctcctgtggagggtgaagaaagggaagctaaggacactgaagcatttagcaaagaggggccagacgtctgccagtcagccctctgtaatttttaccttgaaaaatcactgctagtaatgctcacttccatatcttacactacacatcactaggtacttttaaaattagtgggatacatagtcctatggaaacttctgaagctgggaagacaagacagtccagcccagccaaatacgtccttgtaattacaaccagggaagcatatacttaaccaatccagctagagagatgtgtgcacaaggagaggttttattgatggagtagcccttgtgattggaaccaagtggagtgtaattggaaaggcttgctagatgcagtgagtcttgggcagtcctgagtcatagttcaaaccatggaggtggtgatggtggataggagatgcaagagtcggagagtcatgtgtgcagtgggaaggtggcaagtttaatgcaagggaattagatgatggaaggcccgaaggcaaagtcatgacgtgattgaggggtggatatgtgagctactgctggtcaatggaagtgattaagatgatccttgaggaagataatcattgctgctgttcttaggttaaacatagtggaggctagaagctcagatttggtgttggccaaatggccaagagcatgagtattaggaattgaaagagtatagagccagggctagagagaggcaagttttgaaatgtgtgtccaggcggtgactaaatccatacccccagcaatggggctagggaaatctcaaggccaaagagacaagaggggaaatgagggaatgagctgttgacaaaatgatcacggggaacagtggcatccagatagtcttgtgttcatcagtgaaaatttgcccctagaggtgaagggatggtctgtggttcatgaaatattgaaatcattatctggagaccacaggtgacaatgggatgtttacctcaatgtccaacttaagtttgattgtcaaaattgagccagcaatagattttgcccatccacattatagattgggagggagatttggggtagttctttttgtactggggacaatatttcacacagaggaggatatgaaagtttattttcttaatcctgcctaaagtgatgtctttttttctcttccccgagttggggaccacaccaaagccttgaaaaactttataatactatgcagatgttttggcacatgtaggaagtaatcatacagtaagaaatggttcacttgaaaaaaaataacaaaaatctcttttcaacagataatgattccacatgaaaaccgaaccagcgaggccatgtacaacaaaatgaacatttctgaactgagtgctatgattccccaggttggtgaaaactatccagaaaactttctctcaactcatcattttagaagggattggatttcatctctgtgtaaatttgtgtcttgtaaaacctgctctcagtcttggttatcatcatctttgtcaacaatcacataaaatatcccttgtctgtgtattgggatgccttctgttacagggaacaaaacatctttccaacagtggcttagaaacttaaagcctatattctcacatgacaaaagtctagacataggtaattgttggcattggctcagctgtttaacagtgttgtcaaaggcccaagttctttctatctttccatcctactgtgtttagtgtgttggctttttgacttcatgtttgatgactcatggttccaaggtatccatcacagctccatatatcacatctgctgtcagagcaggaagaaggtgaaagggccagtgatgtgtctaactcttttactaggaaaaacaaacaagcctttccagaacatctccagatgtcttccctttatttcttattgagtaggattgggtcacatggccactcctaaccacaggggaggttgggcaagtgagtaactggttttccgtttcaacagtggacacaggcaaggaagaaaaggttgggaaaagacttttagagtagccaatctaaaaaacaccatatggtgttttaggtaggatagggatgctctgaagaatggaggcatgttactttctgtgtttttatttgtttttttttgagacacagtcttgctgtgtcatccaggctggggtgcagtggtgtgatcttggctcattgcaacctctgcctcccgggttcaagtgattctcctgccttagcctctcgagtagctgggattacaggtgccggccaccacacctagctaatttttgtatttttgatagagatgggattggccaggctggtctcaaactcctgacctcaaatgatccacctgcctcggcctcccaaagtgctgggattacaggtgtgagctaccatgcctggctgcatttactttctgttgctgcttatttcctcttgtgtttttttttttttttttttaaaaactgtgtcacagagacaaattatgtactggggcatctgtttctgtgtgtatgtgagagtgagggagagtacaggacagagaaagggagggagggagagagaaaatgtaccgtatagaggaagaatttagaaggaggaagagaaatgcaggagagaaggagggaagagtatgggaggaagaaagagtatagaatagaggaagagtactggacagggagagagcagaatggggagagaaagacagaggggagagttcaggaaggaggaagagtactggagggggccaagggagtgagggtgcatattactgtgttagtgtgtgtgtgggtgtcgtccagatgtagatggtacagaacacatgctccatttgtgattaagacaataggtcaggccgagcatggtggctcatacctgtaatcccagcacattgggaggccaaggtgggtggatcacttgaagtcaggagttcgagaccagcctggccaacatggtgaaattccacctctactaaaaatacaaaaaaaaaaaaaaaattagccaagtgtggtggcaggtgcctgtaatcccagctactcaggaggctgaggcaggaaaattgcttgaacccaggaggcagaggtaacagtgagccaagatcatgccactgcactccagcctgggtgatagagcgagaatgtctcaaaaaaaaaaaaaaaaaaaaaaaaaaaaaaaagacaataggtctggatggcaatgatcaggagtttattttctagacttgagtagttgcatcttgaattattaggtgtgaaatcaaaagaaatgaatgatgctcaatctactctatctgcctttcttacttgctacctaaccgagattctctcattctgttttgttctctctcccctcagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagtaagaactttcacatgaattttactgtgacttttgtgttttctttaaattataagggcttcccttctcacatcctttgaaaactgtttttaaagaatgttacatcaaaagagtcatagggaaaatcccggtgtcctttgtgatgaactggccaaaagcactgtctggtgtaatttacttgctgcaatgataacaaatgtttttgccctttatttctggtctttctccatgctgttctctttgagatcctaaattgtttatgagcttggggagctagtcatataatgatgttattttctaaaatgtctgtgtgaacatctttttttttccccagttcattctcaatcttttgctgcttttttttttttttcctggttcctttttaaccattaagtcactttctggcaataaactaaagtaactgtattgagaagacacaagaccaccttgagagtggtagaaaaattgcacggataaaacaactttaggaactgccaggtttttcttattttaaagaatgttttagaatttgttgctttgctagtttattgctacaaagaaaaatcttccaatattccaggaaggagaattttacaggttccttaaggcattcagctttgactacagaaaatgaatcacagagcttacaaaatgaatcaacgagtttacaaaacactttactgagttaattgctgggccatgattaaaatcacattttcttatttggactcagacaaggctatgttgccagaagttacgttttttaaaaaaggcacaacagtccttggaagaaaatgtagcatttatcccctacggaaacacttagacacctgagaggagctgctgctctttttaagatactttctgatgataaaagtaatctgtgttcactgaggaaaacatacagaaaaaggagagaagaaacaattaatttacttaaaattctatcatttagagataagccaggattctttgaaaatgttctaaatggaaattgaatctagaggtacgtaattatattgcagggtagagccttgctccatggaccaggaatgtcagcagcatcacctcgggtgcttgttaaaaatgcagattccaaggccctcctccattgagtctgatccagtagagctggaggggaggccaagtaatctttattttaaacaagtacctcagaagaatcttatgattaacttttcttaggggaggggaaggggatcactgtattagaaaatttctttgtaagtacttcctagctctcaaatactataaaatatgacccaaacgattttctactcatatgccattgagttacggagcacattttaaattttggtggtaatttccattgaaaggtggagtttggcctgctttagattcatccttcacctcgtgagtcagtttcttctagtatctgtgttaaaagagtaggtacttctgaacactgattgattttacttccaaaaaagcctaatttacaatcaggggatagattgggatttggtttactgtattagaaaaagcatctctatcgtgatgattttacttggtaattgcaggacctttcataacaatggaaaagagcatgattggagggagattttactctgattcttgtcaaaatgataacttggacaaatataaacgtagagaacaacagtagaaaaaacatagatggaaaagtcaccttagatgttatgtacacatacaacttcatttaaaaataaggacaaaaattggccaggcgcggtggctcacacctgtaatcccagcactttgggaggctgaggtgggcagatcacttgaggccaggagttcaagaccaacctggccaacatggtgaaaccccgtctctacttaaaaaaaatacaaaatttagctgggcgtggtggctggcacctgtaatcccagcgacttgggaagctgaggcaggagaatcgcttgaacccaggaggtggaggttgcagtgagccaaggtcgcaccactgcactccagcctgggtgacatagcgagactctgtcttaaaaaataaataaataaaaataaagccaaatcccaaatctctttcacacagtttatccctcaaccaccagtttataaaaagcaacttgtgttctgcgtattcttgtgagatttcaatacaacgtacacatcatgagaagtctgacagcattttatttgcagactatggtgatgttttttcattgatgatcgtgtttaatcaccactcgtgtagcattacagggctacttgaggaaaagtcttcttgggttcccataattgccatattggtcaggatatgccagttgctataaccagcacctctaaacactcattggctaaattgtaccctctgctcatggaacagtctgaacatgggtgtccctgtaagagagctttcttctaaatagtgacttaggaagccagactcctttcatcttatggctctgccctcccttggatgtttggcatcctctctattcagctggaggatggagaaacagagagggtggaggattgtataggttttggtgggaaggcctagaagtggggtatgtcacttctacccataatccataagccagaactcagtcttgtgactcatctagctgtaggggagactgggaaatatagtttagctatatacccagaaggaaaaggagttggagtttccctagacatgcctttatcaaagagcctatctcattttcttgaaatgaccacttttctctcaatggcaaatacttccctgctccctacctctatgacactgtgagcacctcatggcaggcactcttttttaatttttaatttttgtgggcacaggacatattttgatacaggaatgtaatgcataataatcacatcaaggtaaatggggtatctatcccctcaagcatttgtcctttgtgttacaagcaatccaattatactgttttatttatttaaaaatgtacaattacactatttttgactatagttacctgttgtgctagcaactactaggttttattcattctttctatttttttgtacccattaaccatccctccttccctccttcccctctgctatccttcccaacctccagtaaccacccttctattctctatctctatgaattcaattattttaattgttagctcccacagataagtgagaacatgtgaagtttgtctttctgtgccaggttatttcacttaacattatgatctccagttccactcatgtttctggaaatgacaggatctcattcttttttatggctgaatggtcctccgttgtgtatatgtaccacatttttaaaaatccatttatctgttgatggacacttaggttgcttctggcaggctgtcttgtgattgcttttttaagtgttgtgacctagcacagtgcttctcatgtagtagacactttaaaaattctagaagttaaccagataccccatcaccaccacaaggaggtgacatatgaatggaaccccaaaggataaagaggaattttctaggtagggaagaatagagaaaaggggatggtaagcatcttcagtggtggaaccaatgtgaacttgggtgttgcctgcaaggcagggggctagagagctgagaggccagcttgggctcaggatatgtagaggaaaagcatcagatgaatgttctgaggatccccccacctcctacctttcccttggaggcaccattgaagaaaaagccagccaagccttctcacattgggcatctctgctgtgcctctgtttcgagaatctgcctataaaaatcatatacaggtaatggtgatgttaaccaccactatggttaacatctttgatctttacaacaattctatgcgttgttcccactttacagatgaggaagctgaggttaagtgacttggccaagatcacacctctaagaggaaacagagctgagattctaaatggggtcaccctcatttctatgtcttgtctctttttttccataaatgtcttggtgtgaaaagagatacttttcagatgcttcactgctcattttggagatgctagcgtattgtaccctcagctagttagatattgctagctttggcaattttcctgcaatgttcagcagttcaaagccatcctgtgttggtgtcagctgttcatttcttattttttatttttatttttatttcaataattttgggggaacaggtggtgtttggttgcatggaaaaattctttagtggtgatttctgagattttggtgtacccatcacctgagcagtgtacattgtacccaatatgtagtcttttattgcttaccccctcccactctccccctgagtccccaaagtccattatatcattcttatgcctttgcattctcgtagcttacctcctgcttataagtgagaacatgcgatatatgtttttccattcctgagttacttcacttagaataatcatcttcagctctatccaggctgctgcgaatgccattatttccttcctgtttatggctgagtagtattccatggtgtatatataccacattttctttatccattcgttggttgatgggcatttatgttggttccatatttttgcgattgcaaattgtgctgctgctataaacatgcatgagctagtatcttttttgtataatgacttcttttcctctgggtagatacccagtagtggtattgctggatcaaacggtagttctatttagttctttaaggaatctccatactgttttccatagtggttgtactagtttacattcccaccagcagtgtaaaagtgttcccttttcaccacatccatgccaacatctgttatttttttgatttttgattatggccattctcacaggagtgaggtggtatctcattgtggtttggcacttccctgataattagtgatgttgagcatttttcatatgtttgttggccctttgtatatcttcttttgagaattgtctattcatgtcttttgcccactttttgatgggattgtttgtttttttctttcagctgctcatttctcaattgctgcttctcccttcttatattactcccactgccagtctaggggattaggcctctttctctgactgagtggctgtggggacagtggcactgactctttggtaggtggtgcatggtacagaattagagcaatgagatcctccagtggtggtggtgccaaaccacaccagcccttgcagtccaagggggtaggtggccagggagggacccttggaggaatgagctggaggctgcctgtggggaacaagagctggtgtttgaggtggaaaggggggtggggtaaggaggtagtgatgatccctcatgttatgtgcatctcttcctaactacatgttcggtgatctcatgttgatagtttcaattcaactatgggggattttgacaccatggaaattggcaaatgtaacaaatcatttttctttttcttgacaaggcagttggcaacctttactagcacatcactgggtgaggggcactatagacttctctccctttctgtccccctcaattctcctcctcactcctgactcgaggctgcctcagacacttcccatctacttttatctgaggagtaagagtgggaggaggagaggccaaggaaggttggcatcaggaggagctgacgtgatttcctcttgcaggccagggctggatccatggagatcatctgcgccaggactgttttcttttgttgttgttgttgttttgttttttagcagactggcctagagcaaacccttggagttttgtcaaggaccctgtaagtattcctgtctttagttttattttcatataaagcaagtacaatgtacattaaagtaagatgattcttgttgcatgttcccaaaggatgacctggaaaatgtgctgttatgtggacctctcctgggggccagctcttctgagagtgatctagggtcttgctagccaaagaatggcctacagatgagcagcagagacattactggggagtttgtcagaaatgcagactctcgggctctgccccagacctactgaatcagaggctgaaattgaataagatccccaggggactcatatatacattcaagtttaagaagcactgatgtgggatttaggaagtcctagttgagctgtgtgtgcagaacgatgcggagatggagttttcctagaccagctgttttcaaacctgacacgcctcagaatcccctggagggtttgctaaaatacagtctgctggccccccaccccacagattctgattcagcaggtctggcggtaaggcctaggaattttctaacaagttctcagatgacgctgaagctgctggctcagggacacactttcagaatcactgccttacataagcctctaggcagcctgtaggaagatctctggctttgagaacctttaagaagagcctctgtggctcacttcagatagtatgaccaagacgagcaaatgcaagttctggaatctgaaaacccagatgttagtcctggatttgacacattcttggaagtaccttgacctcttacctttgttttcttcacctgaaaataaggataataataataatcacctcacagcactgttagaaatatcaaagaaggtattttatgatctcttaaatgtgatacaaatgtaagctgccactacaatttgagtatcccttatccaaaatacttgggattggaagtgtttctgattttggatttattcagattttggaatatttgcattataattaccaattgagcatcccaaatctaaaaattaaaagaatcttccaagtcagaggctttaggaaatgatttcatgttgctctctttgtggtgggtgctcttttgagatgctttgcctttctctgtttgatttattgccacttggggaaattaccatatggctgaaaatgtgtttttttgggaaaaaaggatattatgtgttattttcaaggactgttgctgactgtgatttttgctttttgatatatctgagcattaggtgacagtgattcagtcattatggttatatctgttcctggcgtggtaatattagcactccaaaactgtgctccatagcattctgtcagtgtatttataacacactgaagaaactcatcagtgccattgtctcgctgtgtgaacttctcagcattacagcttccagcttgcagaggtctggttgttatgctatcacctttgtaatgccttgtccaggaagtcctcgtaattctttttgtgcccacagatttctgtgaagcatctttgttggagtgttttggggtctctgtgactggccaggaaatcttagctaaattagaggctttggccaggcgtggtggctcacgcctgtaatcccagcaacttgggaggccgagttgggcggattgcttgagtccaggagtttgagaccagcttggcaaaatcatgaaaccctgtctctaccaaaaatacaaaaaaaaatgtgctgagcacagtggcgcatgcctgtagtcccagctacttgggaggctgaggcaggaggttaccttgagcctaggagatcgaggctgtagtgagctgagattgtgccattacactccagcctgggtgacaggagtgagtgaaactctgtctcaaaaaaaaaaaaaaaaaaccaaatagaggctttaattcatcactatctggcatagggaaaagcatgcaggctttagagttagacacacctgggtctggtccggcctccattgcttattacagtggttcttcaacttggcctcacattggacttagctgaggagatttataagcaatatttatgttgggtcccactttagagattgtgacttaattggcctggggtggcctaggcatgtggacttttaacaacttccccaggtgactctactagtttgagactcactgaatatgtgatcgtgagtttacttaatggttctaagcctgaagtctcctcatatgtaaaatgggtataataacatctctcttacagcagcactgtgaggatcataattaatgtgagatgcctaaatgggatgatctcaggggagctggaagggcccctgcttctcaaaccccagtatactttgccatactacatcttccaccaccaccattgggccccctaacaacttccctagttattctggctcatcaccacccctttgagggaatatcttttgaactgatgaaaggacatctgctggctgttgacctccttctcgtctccacctatggatccagcatggttcacatgcctggtaagaggtattttagagacaaagaacataaagtccttgcactaggaccaagatcggcccattaatgtgctagacaccatgacctggtcgctgtctgcatctccccagtgtggctggcctttctgcccacttccttgagtgatgatcctgttcaccatcctctccaacatatcagccgattccaccattatttagcctgtccagagttcacgttcctgtttgcaacaccaaagccttttaacctttcggcatgcttctctcatgaagcctactcttaaccctcagtttgagatgtactatccttacagtgaagtgtctggcacatacttttgggtgctagtgtctaccaaatcattatttatgcacttgcctcatctcccctgctcagctaaaagcttcaggaaatcagggactatccatctccccagcacagagaactgttagtatatatgtgggtgctcaggatgtgttgattgagtgaatgaaagaaagacccttatgtactgacagtgtgtcccttcaattaaacaacccaattacatgaacaagctgaaatctgaagtcctgtgttcccagctggactttgagttctctaactgtaggtgctgggttcttacttctttacgttcctcatggcatctggcacaatacttggccaacaataagtgctcagtgagcacttcttgtcctattaaggagtggagatgtgaatgcaaaagagccaaaggaatgaccccaaaccacttagtggcctcaacagagatgggcaagggctggactttgctgattagtgcagtggtgtcttaggggaatgcgcatatcctaacaagatccattgggtctgagaagaacattttagaacttctatatctttatttaaatttaaaaataattaggctttatacagagtggtataatggactttggagactcagaagcagggagggtaggaaggggatgaggcataaaaaaactatagattggatccagtgtacattacttgggtgatgggtgcactaacatctcagacttcaccactatacaatttatccatataaccaaaaaccatttacatccccaaaagctattgaaataaaaaaactttataaagaaaaataattacactttattgagttctatattgatggctatggacccttcatttgatctgtatggaacatgtgagaggggcactgtcaccctcactggcttgttttcattcaatatattaaaaataatctcagctgatacggtggctcacgcctgtaatcccagcactttgggaggctgaggcgggaggatcacctgaggtcaggagattgagaccagcctgaccaacatggtgaaaccccatcagtactaaaaatatagaaattagccagtcgtggtggcgggcatgtgtaatcccagctacttgggaggctgaggcaggagaattgcttgaacctaggaggcagaggttgcagtgagtggagatcgcgccattgcactccagcttgggcgacagagcaagactccatcttcaaaaaaaaaaaaaaaaatcttgagcggtttacatatagctgtggatttatgaattttattatctagtttatctagtttactacttacaaagtagacaagtggcttaaaaattcttgcaggaaacaggaattgaaatgattattgatgatgtaagcacaagagaacagctagaaattggcagaagtgacccttctcccaggctggtatgccatgttggttagccagatgacaaaagaaatacaatggtggtctaacaagaacaaggacaatggcaatctgacaaagacatgtcatacatttttgaaatagtcaagaagactctaagaaatgtggatttatattcattgtcattgttgtattaaccaaatcctatatggacactgtgtcttgaagaattaacccaatggtgtttgaagaattaatgacttttgaagattttaaatttcattttacctcatcttttgaaatttctgtttttgtatttgttaaaaatattcctaatatattagtctattagtatatctctatagaaattaaacatccatgtattgggtgtgtatgctgaaaaatattttactagtaggagcgcatgtccactgtgtcagaatgtcatacaaatgagagtgtagtttgttcttgatgggcttttagcatcatcatgtcatattgctctcatgtgattggctcaccagaaagccatttcaggaatgtgtgttattagtcaccatggtaatggcacagctgggaggggaatggatcattaaagatccatcatcactattgagttagaaattaactgagatcacacattcttctgaggtcaggtcatcttttgcttatagaaaaaggcaacccttaaaatttaacagatttttaaagatatgtattataggcattacatgagcttatgaggttgttcatacatttggaagtgaaagacaaaaccctagaaattgactatttgtcaagcattttgttatttatttgaaccctgcaacaactctgtaaggtagggatcatcctcattgtatgaaaaataaagataaaatcacagaccttaagtgacttgtcgaaactcacatatttagtaagtatagaatgagggtgcaaaattagatgattggtattagccaatattttgctgttagtttccaaaggcaaagaatacataggcattgtatcaagtcacctaatccagtaagtcctcacttaacatcatcgatagcttcttggaaactgtgactttaagcaaaatgacagataatgaaatcaattttaccataggctaattgatgtaaacaagagttaagttcccatggcatattcctgctcacaaaaacatcaccaaacttctaaataaagaccaaaacacttctaatattgaacattgaatacatgtgagctatgcgtacatttaagaaagacaaataaaagcaagtaagataattttttttgatctttggaacccattcaatgtttttgtagacatattcttttttttatccttgttttcattttttaaattatactttaagttctagggtacatgtgtacaacgtgcaggtttgttacatatgtatacatgtgccatgttggtgtgctgcacccattaactcaactcgtcatttacattaggtatatctcctaatgctatccctcccccctccctctatgcagccataaaaaatgatgagttcatgtcctttgtagggacatggatgaagctggaaaccatcattctcagcaaactatcacaaggacaaaaaaccaaacaccgcatgttctcactcgtaggtgggaattgaacaatgagaacacttggacacaggaaggggaaagtaagataattattaacccagttattctagttcagggttgcaggtgctggagcctatctaggcagctcagggcaccaggcaggatccagccctggctaggatgccatcctgtcacagggtgcagtagctcaccatgctcactcacactgggaatgtgtagacacgccgattaacctagcaggcacatctttgggatgtgggaggaaaccacagcacccagagaaaacctgtgcagacttgaggagaatgtgcaaactctacacagacagtgaccctggcccagaattggttttttccttatcaactgtataacaaaaggatgttgaatgaaatgatgttattcgaggatctgctgtaatttgaaggtactcacaatttccagacacgaaaggctgtgtaacagtggactttataccctgagagtgaaagtaaaatgttcactctgagggctggagctggaatctttccttcatctatctctgttaggtggtgaaaagcaagccaattttggttgtgcttattgacattgtatcatcttatgtcatttctcaagtgaaagttctgcatttttgtatgagtaagaggtccctcgatggagctttgccaactgtttctctcaagatgttctgcagagcatcagatattgacctaaaatacaataaatgggcatctctctctgttaacaggaccattgccaactatttggtgtggagaatggtttattccagaattccaaaccttagcaggcgctttcagtatagatggctggaattctcaagggtaagtttaagaagattgcagtgttacatcgctggataactttacatgctggaatagtccatatattaactgatccagtaaaaatcatctttagggattagacagggggagtttgtagcccaagctctattgtttttgtgtgtgtgtgtgtgccttatttatttttatttaggtataaattacatatggtaaggtacactcaagttttactttgatgggttatataaagatatttagagaaatacttgaggccacacattgttttcaaacttccccgtcttattagtgtattcccattttcccccagagtttttaactgggtcactgtaattatagttttaacatttctttgtgatatatttgtaactatcttttattctcagtattctgaatatttaaaatgtgcatgatagagatattggatggtagaacttcattttcaatttggaaatggaattttgtcttaaactttgcctataccttccatctttgaatctatcctctgctaggtccaagaggctccaatttagttttcttgctcaactgtctgagatggttttcctccacctgctcacctggctctttatttatttatttttattagagatggggtcttgccatgttgcccaggcttgtcttgaactccagagctcaagtgatcctctcacctcagcttcccaaagtgctgggattaaaggcacgagccactgtgccgggcctcacctggctctttaacctttgcttctctcccacccttgctcgtctcccagtttgtacccatgttactctcacctttgtttttgaggcttatgtctgactaattctcctaccactagaggccgtaaggattttgtatctttgaaacagtttttatttttctatcaatttaaagttaagtgaatggtgaatcttataagctatgatttcattcaagaggcattttagttattagaggaactaataagtatagaaattcttagtgggccattactctggaagagtagtgcaattattttggatatgctttgaccctataaagtcactagcatataaagttactttagggctgggtgcagtggctcacacctgtaatcccagcactttgggaggccaaggcaggcaaattgaggtcaggagtttgagaccagcctggccaacgtggtgaaacctcgtctctacaaaaaatacaaaaattagccgggcatggtgtcacgcacctgtggtcccagctactcggggggctgaggcaggagaattgcttgaatccgggaggcggaggctacagtgaactgagatgatggcaccaatgcactccagcctgggcaacagagcaagactccgtctcaaaaaaaagaaaaaaagtcttttttacagagaacagcataaaacaactatatatatatttaggtcatattgatgggttaagatacaaaacaagtaggttttgtgtgtgtgtgtgtgtgtgtgtgtgtgtgtgtgtgtgtgtgtgtgtgtttgtgtgtatttttaactgctacgaatcacataaaagatgatgcccagctgctttccacccctactgtgaagagaatgagagaggtgtaagaagcactgtgtgaacatttaaggttaggtatgaggggatgtttcttgagcacgaagtgctaaatataatattgaattgccgaagaaggttgtaggatctctttctctagaggttttaaaaatagattcatcgcttacctctgagagaggttaccagaaatcagaggaagaatagatgaaattaagccttaatcccattcctcaaaacaacctgggtctaacattgtgcaaaggacacttctgaccaccattctcagggcctcccttcctccctgcctgcacccccagcttccaagggcaacttacactatatttatttctctgcttttattcccaagagtaaacctctgacccaggtcctgcttgggaaacttcttacttgtttgtaaatgttttcttgcaatggtataattgggacagatgggcaaagcatttacatctgtattttgcttgtttatcagtgtgttttttgctgtgacacaatgtaaatatgctccctgtgttgttcatggtgggccatgttcttctggtctgccttgttgagtgtgctactcggagcaaggaaaccctcactgggcaggaactttgatcacccactgattctagaccttcttagtggaactttagttctcaggagatattaaatattatctagacacttggatagcatcctctcatgtccctgctaactgcagaaaagtgataccattgtccagattctttgtttaatggggaaaattgggaagaaaggatacatatattattttaactgttaaatcactttcttttcttcttcttctttttttttttttttttttttttccagacagagtctcactctattgcccaggctggagtgcagtggcccaatctcagctcactgcaaccaccgcttcctgggttcacacaattctcccacctcagcctcccaagtagctgggattacaggcatgcaccaccgtgcccggctaatttttgtgtttttagtaagcacggggtttcaccatgttggccaggctggtctcgagctcctgacctcaggtgatctgctcacctgggcttcttaaagtgctgggattacagatgtgagccactttgaccggcctaaaacattttcatttagtttgaaatataatggggacaagcagaatttttttcttcaactattttacctttgcctctactatctgatgcatatatatgggttagggtgtgcagtgttttgtagactgttttcttcaggttgtttgaattgttttcagccatgggttttatccaaatgaagtttaatctggatcaattatctcccacaggtaatccaggggaccacaactttgctgcctcaatgggacaaatgtgtaaactttattgaaagtgccctcccttatgttgttggaaagatgtttgtagatgtgtacttccaggaagataagaaggaaatggtaagtggtactccccagctagcaaaaaataatggcaatttagccagatctgacaagggtatattcaacaggctaatgtcagccttccaggtggtagtggcctgtgggtattgtcttcagattctttcaacttctaagtgaaataggaagaaaggtcatcaaacgagagtgaggatgagttagcaggtattgaaggttagaggagagagaaggtgtgtagttttccaggggagtgggagagtgaataaactgagggaatgtagtatagctgcttgagggcaggcatgtccagatgtaggtgaggtttgaggtattgaatttaaagagggactcatcactgtggcaacgtgttcttctccatctgtttcaactgcattggagaaaagggtgtatttttttttctttcagctttattgagatgcatttgactaataacaattgtatatattcgaagtatacggccgggcgcagtggctcacacctgtaatcctagtactttgagaggctaagccgggcagatcacttgaggtcaggagtttgaggccagcctggccaacatggtaaaaccccatctctactaaaaaaaatacaaaatttatctgggcgtggtggcaggcacctgtaatcccagctatttgggaggctgaggcaggagaattgcttgaaccccggaggcggaggttgcagtgagccgagatcgcgccactgcccttcagccaaggcgacagagcgagactctgtctcaaaacaaacacaaagtatacaagatgatgatttgacatacattgtgaaatggttgccacaatcaaatgaacacatctgttgtcacacttatttaccattgtgtgtgtggtggtgggggatgaggacacttaagatttactgtcttagcaaattcaagtatacaatacattattagtaactatagtcaccatgccatattttagatccccataacttattcatcttagaactagaagtttgtaccctttgatcaatatctccccatttccctgcccccagcccctggcaactactgttctactctctgcttctatattttaacttttataaagattctacatataagtgagatcatataatatttgtctttctgtgcctggcttatttcacttagcataatgtcctctggctttatctatgctgttgcaaaaggcaggattttcttcatttcttcatttttatggccaaatattccattgtgtggtacacacatgcacacatcgcagtttccttatgtatttatccattgaagggtatttaggtttattccatatcttggctattatgaataatgctgcaatgaacatgaaggtgcagatctttcttccatatactgattttacttactttggatatatacccagtagtgggatggctggattgaatggtagtcctatttttatttttttgaagattttccatgctattttccataatggctgtaccagtttacattcttaccaacagtatatgagcgtttcctttttttccaggaatattttgccaacacttacctcttaaatttttgatcatagccatcctaacaggtagtgaagtgctatttcattatggtttgatttgcatttccctgatgattagtgatgaaaaccttttcataaacctcctgtttatgtgtcgtctttggaaaaatgtctattcagatcttttgcctattttttaatcagattattcgttttttcactattgagagggtgtattttgaattagaaacatggatttggccaagttttttgtctgcattttatttttgatgaattatattttacaaatgtcatgaagtaaaagatccaggcatgattaataataatccgtgtagtcaataagatacaaatatatgagcagcttggatgcaggtggtcaataaacactgaattaaagggcaaagacattgtaatgtcatgattgttcaaatgattggtatcacgtagtgatacataataataccaaatggttggtattatgtatcagtacatagtcattattgatacataatacatgattatgtattatgcactgaagtttgctttgcaataccatatctaagtacatttgtggcaggccaggtctcactaacacaggcctccatcacaactgtcccagcacgtactgagtagctaggttaaacattaaaagctgattgaaccactgcccatatacaaagcctggaatgtaacaaagagcccaccaagagttttgcctaggcttttcctggatcttgaagcatgacaagataatgaatgaattcttaacaggacccttttaggattaaacaagttttattgggggtctgaagaaactccacaggcctccacaaacaagtttactggggtctaaaggaactccccaaacctttatgatttagcaggagacaagataagggtaattacctcagtacctagacccatttagattaagtaaacttactgaggctccagaagaaggtcttcaagactcacacctagttatagattaaaagaagttaatcatttatgtctttcgacgattgcacactttcacgtagacatatagcttagaaggtatatgagctctagaaaactttgtaactttgagttggtctggtgataatttccaggctttctccctgtaaccagtggcagaaaataaaactctgttcttccccagttcatttgcatctcgttattgggccgtgagaaatagcagcctgaccctcagtttggtctgggaacaaattgacctatgttaacttgtttttactgtctaactatgagactttatgtttgaacctgaaagttcccttgcaaataattccactgaggaattaatggcttatttcaaaatactcagtattctcattgcgtgttttcttttgctctttggtcagagtaaatagattgagatcttatcagataatcacagtagtaatattataatctctgggaaggctataaaaacaattaaaggataatgaaagatttaaaaaaattatagcaggttttttggcagtagaagaattttaactaatatgaaaagtatgtggattaaacttgtttttctcagttttggtgtgaaagtcccttttccttgtgtcagggtatgacattctaaaataaagttaattttggcatcttcccccttattttgatgtacgtgggggtagtttggtagttaggcagatactcatctctttaacgtaaaattgtttgcctcccttgtgctgaagctgtttgcctcagggaatacttaggttggaaacttataagagaaatatctggccttttatagcctttttttttacagggctcccatccaagaaccacctggaaccactgatttacttgaaaaacattcagtattattagctacagtctaaagaaaaagaaaaacagaaagatccccaaaggggcaaattccagagaccctaactcagatggaaggctgccattgtttatttaccaaaaaagtttgttaagcaaatgaatacagtcagaagcttaaacttcaggtatgtctcaaatttacatgtgtacataaatcacgtgagcatctgcttgttaaaaatgcagattctcattgcattttaacaaggttttttttttttaagttgtgtttggggtaggacccaagaatttgcctaacaaggttccaggtgcgactgctgctgctggtcgtggaccacactttgcgcagcaaggtcttctcatgattcatttgtttgtaaacagcaccaaaaaaaaaaaaaaaaaaaaaaaaaagcctcggtgactcacaagagcaggccaggccagttgacatgaatagcagtactttatttaccaaaaccggttacattagtgcaagtaactgctttaattttcagatcattgaaaatttctgtgattcagattggtttaaatggactgtgaaaaaccctgcgttaggacctccaggctttatcttttgaaaactgatacctaggttttactaagagactcccgccccacttctcctccgtgtctgttttgagaacctcttgatgacagagttggcccaactgcctgtggttggtaccctctcttctaaagagtgagtgggagagagcagttcacattgaggtttcctacctatcagtgttctcctccttttcactggggaaaacacataattctatattactgtttcactaagacttcctacatccaactgtgcatttggacacaccgatacaccaacgttctcatactcattcacacacacaaccatgggaatttagcaaattgaattagaaatgagaagaatagcatgtagaaaaggagagtccttcaacagaaagccaccaaaagaggtcatatagtacaatcccttgcctcccagttagcaggacagagccttaactcgtgagattggctgcaagtgttgctttgtctttgcagtccaaagtagcactacccaattgaactggaatatgagccacatattttttttgagacagggtctcactctgttgcccaggctggagtgcagtggcgtgatctcggctcactgccacctccgcctccctgtgttgggattacaggcatgagccactacccctggcctccattgacttttatattaacattttctccctccttacctccctttcttcccccattccccagaactaaaaatcataactttgtctatcagaggacttctttaattttttatcttatttagatgaagattatttataattttaaaacattccattagctaagcatttaatattacttttgtggaaagttacatgaaagtgggactcccctagagaattgatgatatatcatcactgtaaatagagatgatgctctcgttccactgtgccaagccctgatccatatgctcatgacctaaatggcaggagagaggattagttgtgttcaggaaggatgtctagagttatcacttgctaattttcccctttatttatttttattttttaatactcttgtctttttctttttcttttttttttttttgagacagagtcttgctccatcacccaggctgaagtgcactggcatgatcttggctcattgcaacctctgcctcctgggttcaagccattcttgtgcctcagcctcatgagtagctgggattacaggtgtgcaccaccaggcccagctaatttttgtattttttttgggtagagatgtggtttcctcatgttggccaagctggtcttgaactcctgactttaagtgatctccctgcctcagcctcccaaggtgctgggattatagacgtgagccaccacgcctggccttgtttgattattattattattgcttatatctgtaatgtataagtaagtgccccaggtagatactcatgtccatggagggcaggtgaaggttccaacgaaggccagggaatgaagggattgtcaccatgggcctagttgtgactgtgatggtcaggacatattggttttaaaatgtggtgatgataataacagtagcagttagctttcactgaggtttaactagctgtctggtattcttttaagtgctttcagtgtgtgaactcacttatcctcacaatgaccctgttactgctgttagtgccctcattttccagatgaggaaacaggctcagagagttgaagtaaattctctggagtcatatagcttgaaaatggcttaggtagggttcaagcccagacaatctacatggaaaccagtgttccattcccttgcttatctctgaaggcacttgaatctttgccagttttacgaatatgaggagaccagaaccttcttagtggcttatcttataattacccttgttagcaaattattctaatattaagatcctaaaagggcatacatttcatattttttaacatttcagaggtaggaaacagttggaataggtttggcttccagtatttcaaaattttaaatataaatatagtggaaacctaattcatatccaaccagttgacatcacatttttgtattcatataattctcaggagaaagacggaaatgataagaagcaagctactattgatttaatctaagaataaccttgcaggtatatctttggctcagtctacacactgagctcaatttctcgtattttgtacatacgtcattctaaggagtgatccctgatgtttgcagtggtaacccaaaggctctgtaagatttattatcaaagtttaaaaaaaaatgtttaccattctctactaaggcggaaatgtgaatatatacatcaaagaaattttttttctattgtgttgatgggaaaaaaggccttgttgctgtaactctagtttctagaaaattcagtaaagctgaagttcccatgtgaacattttggctgggctaagttcttctgtataaaccatgtcttggtttgtttcattgtagacactatgtccccaaactgcttatctttattcatatatctcatctctgccagtaggtattttttgctgctccctcaaattttctgcatttttcttatagagtaaaccctgctaaagcaaataattattttgacacttgttaaaatagtaatgaagactattcaggactattgcaagaggtgtcaagtctattgcaacaggggagaaagattaggcccaactctaaatacagcaaagatagctggagatttatagccagtgaggagaatgagggggtcagtggatggaaaattatgaagaggagacatcacgagcagggaaattcttgttaaaccaacttgacaggattcttgtggaaggcaggccaaggtgatcaggatggggattctttctaaagtgacttagcaggattcttgctacaactggactagacaggcttgtcgaggacaggatgggggtgggaggctgggaggagggtaagggcaagacgtacttgagaagagggctcagaggagcctgactaaactttggtcaaggagagagtctttgtcagctctcagatcaaagctaaagtcactgatctcctgtcatatattaaaacattctatatgcagaaggttaatctagttaaagcagagcaaatctattacacttcagattcagattttattaagtgaagaactaaaacttgactccctatgtagaacaattcactaatttctcctgcactctagcagctattctatttctctttaaagacattgttcatgtccccaagtaatgccatggatgccctaaaatatcttccattttttctgagctgctctctgcctgagcaattccagtagtaattcttatcctaagaaaagaattctcctcccaccccatactgctacatctggtgttgaagacttaaatacccacgtgggtccaattgcagtggcggagtttgaacttgcaacctcaatacactagaagttcacctcattagtgagctaagataattgaattgatgtactgccattaatattctttaagttctccaattccctcgctcactgtttctctcagtggttgagtaaatgagatgtaactataacgttgatggcagaagtcacatgaaactcagtgtcatgcattatagcattgcccttatactgaggagtttttcgttccttgcaaattcagctgctcacaaaggttgttctcagtaaagccactgtacagataaagacaatggtcccttcatcacaaattgtgaaagaaaggatattctctttggctactaaatgcccgtttctgtttgtctagtaagtggtgttggttattattatcaagatcactttccagagaaactttgctgaagacctgtccaaattaaggcaaaccatgatgatttggttttttaagggctttttaatatatttataaaatattgacctaatatagaaattacatctgattttctgcaaagttgcattgatagctcatagcccagctctgctcttaccaacatgggcaaatcagttaacttctttgagcttgttttcctgttataaatgatgcaagagtttctgttgctttggtaatgctgtgtaacaatcaatcacaaagcctcactggcatttgacaataagcagttactgctgatgcatctggagtcagtggtgggcccccatgcagctctgttgattttggccaggctggcttgaatttctgggggttggctgatcaaggttggctttggcagaggtgattggaatgactcggctctgcttcatgtgtcctgcttccttcagccggctagcctgtgcatgttctcatggtgatggcagaagttcaagcaagcaagtagaaacatgtgaggtctcctgagacctaggctcaggacaggcataatgtaatatctgcattttgttggccaaagcaagtcacaaggccggtccagatttacagactagggagatagggtctgcatttttttttttttttttttttttgagacaaggtctggctctgtcccccaggctggagtgcagtggtgcgatctcggctcactgcagcctctgcctcccaggctcaagccatcttcccactttagcctgcgagtagctgggactacaggtgtgcgccatgatgcccggctaatttttgtattttttgtagagatggggctttggcgtgttgtccaggctggtcttggactcgtgagcttaagcgatctgcccgccttggcttcccaaagtgttaggattacaggtgtgagccacctgtaactctgcatttttaatgagaggatctgcaaagtcacacagtaaggggtgtggataaatgaaggagtatggcattaaagctgtcagtgctgtgtatcacaaatagggataaaagtatacctccttctttcatttgaggtgagagttaaatgatataatctatgtagaaggcctagcataatacctggtacacaaaaagtgctcagtgaatgtcatctactcttattgctaatattgccatgcctaatgttaataattaagatagaatttataatatcaacttcctggcacagctgtggcaacttctgcatttagattgcctctttttaatttatcatagagtgagggaggtgcctggggggttttgctgtcgctactcctccatacatgcctagtatagtagctttcattggaataaagatccttttcatgttagtgccctggccacattccagaacccaccctatcatttaacgccaagtctggctcatacaagagtctcatgaaattactcatgaaattactcgaggagccaaatataatttctttttcttttttttttttttttgagaccaagtctcgccctgttgcccaggctggagtgcagtggtgcgatcttggctcactgcaagctctgcctcccgggttcacgccattttcccgcctcagcctcccaagtagctgggaccacaggtgcatgccacctcgcctggctaattttttgtatttttagtagagatggggtttcactgtgttagccaggatggtctcgatctcctgacctcgtgatctgccctcctcagcgtcccaaagtgctgggattacaggcatgagccaccatgcccggccatgtaatttctagaataggtccagatttcataaccctctgcaggctaaatcttgttacaacaaatatcatccggtcccaatcgtgacagctcatttatgcaatcttcggtcaagtaacatccagcaaaacaagtaatttagatagctcattgggaattcttttgaaataagtatgaacacttactcttgtccttgtctttgagtgtgctgccacgacgatgacacattggctcacctttcttgtttgttttctccatttctggctagcattgggcagtgttgcctttgccacatattatcagccacagtcttgtcaagcagatctggtcagacctatggaatgtgaagaccctttattagaaattcatttacctaaagaaaacatttatgccttccaacagatctgaatgttggaagtgaccagacatagttacttgctggggagaatttacccacagccaaaggctagactatttgagactgattgacttgtaaatattattctggtttctgatccatcctctcttaaagttggaaagtggaaaacaggaaaagatgagttataaaattagaacacagcctatatgttcatatccagcaaatagaaatataaatatctacctgagtcttatgaatatatacctttagataaaaggacatgagaaactcctcctgtaccaccagaataacccactttatagcaccaaataatttgattttttcttcttttgccaaaatgtttaatagctatgtaacactgctaatcctgacaaactgatatgatttattcactcacttggctgccagaaacctcagcattttctaactatccttagttcttctggtttaaccacatgtcccacttcaatataggtcactttttacttattttgttgccattattttttatcaggagccaatccaagggcatttttataaatagttatagtataagtaattaattaatgaatatttcatatttattggtgcattcatttatttaatgtctgtgtttctagtaaagtgacaattgccagaaagaaaattttaagagtccccctgagattaaagcctatttcttcagggttatccacataaattattaacaacgatttccatttttcacattccaccaatcagtggttacaactcaagaaaacttgccctgttctagagcaatgagaagactggaaacattttaatctcatggtttttttccagatattataacttctaagtatgttaaagaggaaagcctactcaacattatgccttttcgttaagaattttattaacattaaattagtttaaggttaatgcccataatcaaccttactgattttttttctttttcctttcttttctttttcagaactcctagcctataattattcctactagatatgtactatatttttaaaccattccaagctgtttgtcatgtaccatgttgacatcacctatcttagaatggactaggctaacttacagagtcacttgatttccactaaagtttgtgtttggtagtaggctacagtcattctggagacatttgctgtgaaccttgtcccctaatataacgatggattttctattcactgataagttctactcatggattcaggctttgaattactaaatcagagtaggtctctcttttcaaaaatgacttcacctaaaaagggtaccatgcattttttttttccctttttcagctttcatgttgttaaatctcatgatcatatctgcacagcaccatattttctatgagtgagtttgttaatattttctctttatactattggaataactgttatctgttagcatatatgaaagatatttgattcaatttcaactctgctaggtgccaattgaaggtttcaaaaagcataaattgatcagcttgtatttactgagcatctgctatattttagtattaggtatgaatgtgagatatggactcgtgaaaaatcatatcacatgagatatgaaatcataaaactaacaaaattttaaattagcagaatacttttttgtttgcttacatattcatgatctcatttgatctaaatcatggttcctgttctcaaagcttatgggtcttgttagggagaccaaataaatataaatgaaaagacaacaattaaacacacacctatgtattattctgattttaagcctcacaggaactcagagagggaattgaaagtgtgggtttaagtgtttgggattcatgggtatgagataggatttgagttgccttgtgggatttctttattatcagggacaaagctttgaagaaaactacaaccgatcatggggcaaactaatccctccttaaagcaatgttggcatatgtcccttcaaatgtattaatagaaccatcatgactcatttatgcaaagtacagaattcttatgtctatgtgatgggaggaagggtaaggagagggcaagaggagcaggagagataatttataatttgctaagataggagcatctcattaaagtaaagccctggattgaagggtaacaagtgcctatgcatatgtgactcaccaatgtctggtgtctgatgtagaactctatgggcaaaatcctggggtgcaaagaatgaaaaaggaagaacctatttttagataacactggttgaggaagagaactaagaactgcccatagatcaaccaaatgaactgtatttttatagtgtggatccataaaatctgaaatagttgtttttttttttttttttttttttttgagacagagtcttgctctgtcacccaggctcgagtgcagtggggtgatctcagctcactgcaccctccacctcccgggttcaagcgattcttgtgcctcagcctctcgagtagctgagattacagttgcccgccaccatgcctggctaatttttgtatttttagtagagacagggtttcaccatgttggccaggctggtcttgagctcctgacctcaggtgattcgcccacctcggcctcccaaagtgctgggattacaggtgggagccattgcgccctgcccctgaaataaatagatatttaacaaaacgttgctttgcctagagggctcttaccctgaatatggcagattttaccaaaataacacttgagttaatttttatatgttatattttgacctttgactggctctaaataaatatttcctatggataacttcaccttaagacttccactttaagggatttctattaatgttatatgctgcctggttgaggtgtgaggtccaagtttggtgaagaaatactatttctctatttttttcttattttaaaattacagcaggtttttgacttgactgaaggcaatgttattatgtgatgctgtagagtagtctaaagataaaaatcagaagtgttcagtgatttatcttcctagttccagcatgctaaaataattatttctcttatttgcattgacatgtcaaccaatgaaattaatcaccttcaaagattttccttgttcttgaagtctgctggggtagttcaacaccatttcacagaaaatgttatacaataaatctgtaaagtctgccaaaaaaaaaaaaattgagaacctgaggtgggggatggtgtggggagtggaggtgccagagaagacaagggcaaagagcagctgaggctcatgggaaaaaaaaagtgatttacccgcgttttgacaaatgtgagagggccacaaagagtgagttaccgaagtgtggattcagggaagacagaggtggtgggggcaggggaggaggtggaagaaaaggcagaggagggaggaactggcatgtgaataaactatttgtcatttttcactctggcagtgggctgaaatgtttttgcctctttttattttcatttagaatgccaatcaatgggttacagacaaagagctttgaaaaccttttcttatttatttatttagagacggaatcttgctctgtcgcccaggctggagtgctgtggcgcgatcttggctcactgcaacctccgcctcgcgggttcaagcaattatcctgtctcagcctcccaagttgctgaggttacaggcatgtgccaccacacctggctaatttctttttttgtatctagtagagacggggtttcaccatgttggtcaggctggtcttgaactccagacctcaggtgatccaaccgcctcagcctcccaaagtgctgggattacaggcgtgagccactgcacccgccctgaaaaccttttcaaaatgcattaaattttaatgaatttgatagccattttaatgcctgggagatgctggacagggagggtcctatgaaaccaagctgcttagagagaagtatctggaaacactcagccccattttaataatagccacatactccataaaaatacctcaaagagaacaggagcaaaatgaccttaagattcatcataggaatccaaaaattccaaaatttgctgaagatctttttagcttggagagtgcttatttttttgataatttattttaaaacctaataaaatgttttgcttttgtacaccttgtcccaaataaatattttctttggacatattcaactttttattatttattgggtgctttctattattgctacatcctggccagggtattgagagggaaccttttattgtcctctttgtccctatctgtaaatatagtaatccccccttatctgagacagatactttccaagaccccccccaacccccgcccagtggatgagactggggatagtactaaactctatatatactatgtttttcctatgcatatataactatcataaggtttattttataaagtaggcacagtaagagattaacaccaataactaataataaaatagaacagttataatgatatactgtaataaaagttatgtgaatgtggtctctctttctctcaaagtatcttatggtattgaactcatgcatgtacttcctatgatctgtctgataaccaagatagctagcaagtgactattgggtgcgtatatacagggtggagatgctggacaaacgaagggtgattcacatcccgggccagacaggctgggatggcatgaaacttcatcacactaatcagaatggtgtgcaatttaaaatttgtgaattgtttatttctggaattttccatttaatattttcagaacacagttgcccataggtaactgaaactatggaaagcaaaatcgtgaataagggggtactactgtacttctcttcctagtaatatgttcatgctgccaggatgcacatagccatgtgcgaagaaatataattttttagataaacctccctttaagcagaaggtctcaatcctatttcatggagaaaagacccacgtttatactaggactctctcaaccttctacatctaatctttagattcttctgcatgcctgcctatcattttaatcttctctcctctcataagtctgtctcatatctaaggtgaatccttccatatagtctctggatcccatcacctcctttgccctctgagacaccactcatggcttgctttgtcccatattttcagtctcttccttttcgctggatcctttctattggtatttaaacatagtcaaatctctcagcttttcaacaacaacaaaaacagtaggaacagcattagcaagcatatgcatgaaacccaaactccaaaccctcagacccttcccttaaccctacctctacttctctcctatctttgctttttctccttcatagacaaactcaattaatttgtccagacttgctgtcttcgcttcccacacactcttcatcccactagtttggcttctgtccccatccctctttttcttccaattttctcagtcttattgaatgacggtgtttgccaatatctttctgaagcctaggaatgaatctgactctctctacgttcctcactttcccacataaaatgagtcacctgtttccattggtttggtctctaaatctctcctttgagtccacccacttctttccctccccattgcccctccctaatttgggaagatataatttctttttctctgtgaacgtgatgggccagccaatgcatgttgctacatgatgagtccctaaagacttagggccaggtgtggtggctcacgcctgtaatcccagcactttgggagactgaggcgggtggatcacctgagctcggaggttcgagactagcctgggcaatatggtgaaagcccgtctctactaaaaatacacaaaaattagctgggcatggtggtgcatgtctgtgatcccagctacttaggaggctgaggcagaagaatcgcttgaacctgggaggtggaggttacagtgagcagtgagccaagatcatgccactgcactccagcctgggcgacacagtcagactcattctcaaaaaaaaaaaaaaaaaaaaaaaacttaggcatgctgataggcaaaagatctagtccccggagatttccttgtcattttaacatcctcctgatgtgggttttctgtttgaaattgtgacttatgcatctctcagttgattccctttcactccctggcatttctctctgattttgggagggatcctctgttgttactagaggctctgagctctccactgttattttagctctttggtcaggtcctggctctggtcctcattagctgtgtcagcttgagcagatcatagactccttgacccttaatttccttatctgtcaaataaatggtttcccctggtctagtgggtctcagccctgactgcacattagaattacctggggaactttttaaaccctcccaatgcccaggctggacctcagaacaatgatactagcatcccgatgcccacgacgcaggattttttattttatttagaaattttttgtcagtattattttttttttcttttgagactgagtctcgctctgtcacccagactggagtgcagtggtgtaatctcagctcactgtgacctctgcctcccgagttccagtgattctcctgcctcagcctcctgagtagctgggattacaggcgcctgctactacacccagctaattttttgtatttttagtagagacggggtttcaccatgttggccaggctggtctcgaactcctgacctcaagtaatctgcccgcctcagcctcccaaagtgctgggattacaggtatgagcccctgcggccagctctcagtattttttaaagttcctccaaagattctaatgggcagacaaagttaagaaccaccgacttaatgatttttaaaggaccttttgctctttgctcttctagcagtttgtgttttatcccaagttgaagtttctcttcttttaatgtttttaccaagttgggaagaaatagctgtgaagctcccccgacccccttccatctgctgtttgttcttatttacatatgatggaacccagcccactgatttatagctctggttccctcacaactgttattgaactgaaaacatagctgaaaacttattaaacagaaaaaacttattttgagcttcatgctgacaatttattatagaaccaaggaaacatttcaacgtctttccttctagagttaatgttaacaattgatttacaaccccatgctctcaaatgaaaaagttcattctggggccaaacccagtgttttttttttcttgggtgtcccattgagaaagccaaagcatctctgcaggagaactggatttcgaggggtttgtatccatgaacaggcagggcctcctcacattgctgccggtggcctctaatgtgacgtgtcagtagcccctttcctccagtcctctcttctggtccacagacaccggcagcaaagccaggcacgtacatcctcactatgggtgtggcctcactgttcaaatgctttgcgataggtctttcagaagtccacctttcggtagcagccccctttagacctaccattttattttattattatttttttagagacaaggtctcactctgtcacccaggctgaagtatagtggtacagtcatagcttactgcagcctcaaactcctgagctcaagtgatcttcctgcctcagcctcctgagtacctaggactacaggtgcaggcgccaccatgcctggcctttaaaaaataattttgtttttatagagatgaggtcctcttgtgttgcccaggctggtctcgaactcctggcctcaagcaatcctcctgcttcggccttccaaagtcctgagattataggggtgagccactgcccctggcctatacctacccttttaaattggaaataacaagacttttctgagctgccaaggagtagagaggagagtaggaagatgatatagaagagccgaacatttagtttaacccacggaactaaatctggaaagaactggggtcctgacataagtgtgattcatattggtgaagtgtcctttggggtgctaagtctccctgcccgtttctctgtgttaacagttatctctttcaactgttcactttcttctgcaatacctatctgaaatgcacagcccatgcctttcctgtctctctcagtcctttattaaatgattaaaattagttggcaccttgataaggatgaactagtttagtagctacagacaggtaagttattggtttgtcataatctatggtgaattcctatccctgtatacccgtataattcattttatagctgggccaccacattattctcatggaaagaaatggttttttttttttaatgttttttattttttggagacagggtcttgctttgttgcccaggctggagtacagtggtgcagtcatggctcactgcaacctccacctcttgggctcaagcaatcctctcacttcagcctcctgagtagctgggactaaggcatttgcctctacaccaagctaatttttatattttttgtagagatggggttttgccatgttgcccatgttggtcttgaactcctgggctcaagggatctgctcatctcagcctcccaaagtcctgggattacaggcatgagccaccatgcccagctaatttttatatttttggtagagatggggtttcaccatgttgtccgcgctggtctcaaactcctgggctcaagtgatccacctgccttggcctcccaaattgttgggattacaggcatgagccaccatgctgggcctggttagttatcttttagtggtggaaaaaagggaattttcctggaaaaagaagtgttgccagagcatggagtcaagctgaaagaaccccttacttaccatgttgagtaaagagtcatttctcatgcaagccaattttgttccagaaaacctcgactgaagcttcttggctttgacgttccctctttgggtattttcttgtagatggaggaattggttgagggcgttcgctgggcctttattgacatgctagagaaagaaaatgagtggatggatgcaggaacgaaaaggaaagccaaagaaaaggtaaggattccttttgatgaaaaaaaaataagacttctggtttaatggatgttcatgcttgacattgactgtgtagttggtttttatattgactgaactgttgactctgaatgaccccagagttagctgtctgcttttggatgaatacatagatttttgtttcaccaggaggtaagagaaaataatacctgaatttttcgaactgcattttcaaataccttgtaattcggcctttcctttctcctaattgctgtctgtaagaggcacatggcttgctgcctggtgaattgtgtcataaaccatcactggatatggcagaatgcagagcagtggggagtcacagggagcagctggaacaagagcccctaagacaccaaaacgaagaaaacccatattggccacatgtccttctgctctgtgcatgatgcatgcaaatgtcctggggcaaatcctttcctgtaaccaagcatatctccttcccgacccatcatttggcacaaatgacccaaatagtatactgataaactgcagaccagtgttctaccattgcttaggactacaaacgtatttcctaatagaagtggacacttgctgggccttgtaaaattttctgatactatgcgacacgataagggaacaaaggagaaaagtattgacagccatgctgtttaaaagtagaaaacgggctgggtgcagtggctcacgcctgtaataccaggactttgggaggctgaggcaggtggatcacttgaggtcaggagtttgagatcagcctggccaacatggcaaaaccccatctctgctaaaaatacaaaaaaattagtcgggtgtggtggcatgcatctgtagtcccagctactcgggaggctgaggcaggagaatcgcttgagcctgggaggcggaggttgcagtgagttgagatcgtgccactgcactccagcctgggtgacagagcgagactccatctctgaataaatgaatgaatgaatgggatccattttgaattccagagattctgatagagctggaattcaagtgggtggagcatacctgctagactcttgatggatgcttctctgcagctgagcatttcttgtatctagaggtatttttgaaagcttcctgagtataacaatcacctgggttgcctggacgctctggctttctgggccccttcccagcaaggcctgggttaatggatcatggatgcaggctgaacagctgtcactttagccagtctccgggtgattgttatcactaggcaggtctggggaaacactgcctggagtcatactgagtcatactgagcacaaatatttttgcctcagcgttctgggaatgcttaaccttgttgaaatgagaacacgtagagttttagcaaggatattttctagtgctttaaactcatggtactggagatggataaacattgccatagatacttttgtcagtagatgtgaaaaggcgtttgttcagtgtttataatgaaggaagaactgggatggtgggtggcaaggcagcgttggaggaagacaaagagtaggtttgattttttgtttccccttcaaaaatctgtcaaagctgtcctcagtcacataaggcacaggctgatgaaggcaagagcacatgggctgtgatgggaaactctccagatggtagacaactttcaacaccaacatattgttgttttatgaaggcttcatttatttgctgagctagcttgtggtatgtggaacaggatgtgtcttgccctgggcagttgagcgcttagtgtattaagggctctttatcctcgcctgaccccacatgaaccgaagaggtgcttgcatgaattagtacaggaccaccagggtggagggtggggtggagtgtgtgtgtatgtataggtgttgggggtaatgtgttatgaatagctggatgccaggggaatgttctgggaagtgcagtcagttctttgagcagtgtggattgcagttgcctcagggagctcttctgagtggcataagggagtgggtgcctcacagttggcccttctcggcaagtggcccatgggtccttcttgaagcaggactattctcagttcttctaatattagacatgttcctgtttgcctcccgagttgctctccagtcttctattttatttcaatgagagctgtcagtttttcttctaaaagcgttctttgaacactctgctttctttgagctgagttcaacctgccaggaactctgctagttccacgacaggtacaaatatcaaaggcaaattggatctcacaaagttccccgactgtatcttgcatttcagagttcagagaagtttctttaacgaaatgcaagaaagatggatgttgttgaagcaatttcagcagttctttgaagtgggtcctttcctggaccccagaagatgtaaattttttttttttttttcccctcaaaattaaatgaacatgcagttcttaaaatgacctctgggtggagctcgtggtactcacaaagaacactagcggcgttgaaagcttttatgcagctttctactccggcgttgtttttgaaaaaaaaaaaatttcttgccctttttctctgctgtcctcgatttgattgccttttaatagtcaacaagaaaggagagactttgcctaataattccttgaatcttagatggaaatctcccactatcttagggttttgtctttctgatactgagtagcccctgcattaagaaaggatttgcctgcatttgaagtggaggtgaataactcgcctgctcttcctggtatgacttggcactgttctttgggcatgtgttgtatgcagtgtatcacccaggcggaagatttctcatcaataatagtgcccacactgggccaatgctgagtcacttggcaacccattgggaaagctggaaaaatgttctgatttgtgaaagggagaagcttttctttccctcaccatgaagctctggaccgcagctaattacagagcctcctaagaagtgttaacctcagcattccatagtgaccgacctcctgaaccgggcaggtacagaaagctgcagtgttctgaggcctaataccttggcttttgtagcaatgacctcgtctcaaaatggaagtgtgtggatgtggctttgttgtactctttgctaggggtgttcactgtaaaagataaatgaggatgcctctgctcccgtgaagggtaaatttgttttctctgtctccctgccttttcctgctcatctcttaagaggtcacgagtagtttttgtattgtgaaactgatggtgtaggtttcaagtggaaatttagtatcgtgaaataagcaccgctttttgtttaggattctctgttccctgcaagcatgtgctcttattgtaaataagcagcaaaggacagggcatctgttatttttctggtgaccacagctgttgaatgagtgtcaggtgataaaataatgattttaggggtgtcttctggaggatttgcccttgccagagtagaagaggaggatctcaaggtcgctacatcaggattctgactgagacctggcaggagagcgtcagatcaggaggagcaacttcctgagcttggcttatctccagctggatttgactatatagccaaaaagctggatcccttcggaattatttgtttgtttgtgctctttgcccctgggacctaagtttgtcaggtcacatccaaagaaaaatagcaggatgggactcacagggaggtggcatcctaatgatgctctgagggagtggccttaaccttggccacagcaggtgcagagaagtcggctgaatggtcctaaatttattggcatgtgactctcacacacaggctttgagtgaggtggtgagagttttcttgcagagggcgaaacagaggtgtagcccacttctttggctttgtctctaagctctaccaggcctaggtactggacttctcccaggtatgcggtcagggctctgcttatatccggagcctggtggttctcaaggtgtggttccagaccagtagcagcagtggtccctgggaactcattagagatgcaaattttcacatccccacctgctgagctctgggagtagggctcagtgccttgtgttttacctggtgattctgctgcgtgaaaagggttgggaacccctgtcttgtccttaccacttcacagcacacctgcctgacttccaactgcagcctcctgcattttggccaagagcattctctccctgctacagcctgctttgctactcataaagagggcccaaaggacggggaatgaccacaccttcctcagaagtcctcacccaacagttgatgggagttgctgtgtgtggcccccgctccctcatccctctagtgcgtgttccacatgggctctgggagcttttccaatgggctagagctattatactagctaagatactcgttgctgactgcctttctttctctacatatttcctctttctcctaccagtgtttcttttgctgcccaaatgaactgctcgcacttgaatccttgtcttagagtctgtttctgggggattcccaactaggacacagcccctgggggtatacgctttcccagtgcttccttgcctgtaaggcaacagcacatttcaccgagtctggttgctagcactgcttcagcagactcaatgccacaaacatttctagcacaccaacagcatgccaggtgctgagccgggattcggactcagagatgagcagccacagtcccttttctgcgggggccttcaggctcctaggagagaacaggaggccatggatgcagggcagaccaggagaagtgttaggtaacgtgatggagacgaaaggggtcctgggagtctaggggagctcaaacatgacatgtgagggtgccttacttgggaagtgcctactctgcccctttctctcttcctctgtggtgttcccacaccctgtcttgcagccttgtggcaagtcttcctcttccttccttactaatcccaactctgcatctggctgtcacttccccttgataccttcactcctgcttcacctcactgtgcattttaaattgtttcgtaggagaaaagaaacagaagggctttcatcaaactgtctcctgccctttccagttacagattctagcacatttgcataaccgctcaagaatgcagtcaccctgcgtctggcatccactccagggctcaccagggacagtgactggtagaccagcatggaaaccgcgggctgtggctccctcccatgtgccaccttcccgagcttgtcccttctctttggctctatgtctctctcacacacatgcaggccaagatggcggccttcatacttgtatctctttcctctcactggcctcaacaggaagtatggtatagaggtcaggagtatagacaggtgagagactgcctagtttccaagccaacttctacaccttattgactgtatgaccctttggaaattacttaacttcttccaccctcagttttcacatccataaactggggagattggtccctgtctcagaagatttgttatgaggattaaaagagccactgtgcctaaagtacttataagaatgcctggagcatgagaaaggctccccaagttgtcagccgtttggtccaaactgctgtgcctctgggaggggaggctttggctggaccagacggtgagaggagggatatttgtgagcagcccctgctgagagggtgttggaggggatgcatttcttttctctggattttggattttgtggttttgaacaaattcagtattgtcgttgtgatatatattttaaacacaaaagtaaatatctggtataagtgggagtttgatgcatatatctatttattttttcgagttaaagtctcgctctgttgcccaggctggagtgcagtgttacaatcatagctcactgcagcctgaaactcctgggctcaagcgatccacccaccttagcctcctgagtatctggaactataggtgtgtgcccccacccaccttagccttctgagtacctggaactataggtgtgtgcccccacatccagctaagtggttttcttaatttttttttttttttttggtagagatgggatctcactgtgttgcccaggctggtctcaaactcttggcctcaaccgatccgccagctacagcctcccaaaatgctgggattacagtgtgagccactgccacacccagccaacatatatttattaaaggcatagtacatgtgatatcttaccggagtgattttccatgctctagagcctcatgtaaatgtcatttagggggatgctttaggtcattcattctcacacttgagcatgcatcagtgccatctgaagggcttgttaaaacaccaattgccagccccacccctagaatttctgattcagtagtgctaaggtggagcctggatatttgcatttctgacaagttctcaggcaattctgatgctgctggtctggggcctgtgctttgagagctctaggtgattacaagtgaaaatgtccttatgccaagcctgtgttaatagaagggtataatgttcattaagtgattgtcttacctcttactggagtccccttttcaccatttctcgcaggtgggtcccctgagtgagtactaggacacccagaacccagccaggccacctactctactgttgctgtctctgctaaagagccctgcttgagagagatccaaaggctctttcttggtcatttctgctccttgactccacatctgtccccaggaactacccaggttaagtcttccacataaaagcccttccaacgtttgaagatgtttaaatgtttttcttttttctttattttattttatttatttatttttttcgagacagagtcttgctctgtggcccagactagagtgcagtggtgcaatcttggctcactgcaacccctgcctcccgggttcaagtgattctcctgtctcagcctcccgagtagctgggaccacaggcatgcgccaccatgcccggctaatttttgtatttttagtagagatggggttttgctatgttggccgggctggtcttgagttcctgacctcaagtgatccgcctgcctcagcctcccaaagtgctgggattacaggcatgagccaccgtgcctggctgttttttctatttcaaataaaacacctttagtgtttctcacattaaattaaccaacattacagtcagactggatgttctaaatgcttcacaaatattagctctctcaatgccataatatccgtatgaggtaggtactttttttttttttttaatacagatgaggaaactgaagcacagagagtgtgagcacacttacccaaggtcacacagctagtaggtagaagagctgggattccctccctagaggtctggtttcacagtctgtgcttttatccgcaatgccagtgggtctcaaagtgtggtccccagtccagaagcatcgccatcactcaggactagctaaaaatgcagattcttggctctatcccacatctatagaatcagcaactctgggagaggccctaggcatctgtactttaatcagtcctgctggtgattctgatgcagcccaagtatgagaaccattgctctaaggtgtggttctgatgcctcatcctgctggctgctctccagttttcaatatcttttttagaagcttaagttcaaggctgtgcacaatattctaggtatagtgtaactcacacagcacaatgggaatattattactgcctttgtcttgcatacaaattatattaagaaatccaaagtttacattatggctatcttttcccctcagccattcactgttggctcataacgaatttctagtcagttaatttctaggtctttttttccccgctcacaggaactgttgttaagccctgttgctccagtcctaaacttggcattaaaaaacaaacaaaaaaaaaaaccctcatcccagaacttcacatttattcttattaaaatccatttagttgttttggttcatggctctggctttcaaaaagtatatttctggacctcctacatgtttattattgttttaaaaatctatgctcatttaaaaaatctggaaaataaagcacaacagtagaaagacaaaaaaaagttctagttccatcatctaaacataactgctgctaacattttgatgtatcactttgacttttttcccatacataggctttgaaaggcattcttgaacaatgatgtttataaaaatttgagttcttttttctcttaacatttattataagcatttcttgtattattgcatattctttatgcaagaatattcactgttggctgggcacagtggcccacacttgtaatcccagcactttgggaggccgaggcgggtggatcgctagaggtcaggagtttgagaccagcctggccaacatggtgaaaccctgtctctactaaaaatacaaaaaattagccgggtgtggtggcaggcgcctgtaatcccagctacttgggaggctgaagcaggagaatcgcttgaacccggaaggcggaggttgcagtgagccaagattacgccgctgcactccagcctgggcgacagagtgagattctatctctcacacacacaaaaagaatattcactactatgacatattcttctagtggtggcacaggaggtactacttaaacatttctctatagttgcatgtttaggttgtgctgttatagttattactatgatacacatcttttgcataatgccttctccctaaatgtaggactaattccttagaatggcatctcagacaacctttgaaaaggtcaactctttccttcagtatatcaactactgtttctatgtcgttcataacttgataagtttgttttttagttttattattttggggttattatgaatggacatgctcaaaaaaagggaattggaatcagccaatttgttcatcctttggcaatgcccttccagatttatctattgaacaaaaatattcagggagaaacttctaagtggtgagtcttttgttaggtgccagtcaattcactaactaatagatttttggtctagttgttctactttggacaaactccatggaactatgatttaaattctcccttttgcctgcaaggagaccttgagatatttagcaatgcgttgatatcatccagttatactgtatttagggcattctttaatttaccaatgtattgttctgtttaaaatgtggaaacctgaggaaatgaacaaagcttcactgggttctcatttttctgaagttccatgttacctaagtgcagattatatcattctgtgaaaacagccagctgttcaggcaaccaaatcagaaatctcagtctttcctcttagccaacttgtaagcacaaatcgtgttgcttctttctgccagctctcaaatttataccatttctgttttagttattcccctcccttagcttctcatccttaaacattttttttaattgaggtaaaattcacctaacataaaactaaccattttaaagtgaacaattctcaattagatagaagaaataagctctcatgctcaatagcagattatagtgactacagttagcaacagtatattgtatattccaaagcggctagaagaaaggacttgaaatgttaccaacacatagaaataatgaatattcacagtgatgggcactccaaataccctgacttgatcattacacattctatgcaggtaaaaactactcacatgtacccataaatatgtacaaatattatgcatcaataaaagaaaagaaatgaagtgagcaattcagtggcacttagaacattcacagtgttgtgtgatcaccacctctatccagttccaaaacatttttgtaactcccaaaggacactttgtacccattaagcagtcactctccattccccactcccccagctcctgacaactaccaatctgctttttgtttctatggattcatgtattttggatatttcctgtgaatgagatcacgcaccaatgcgatttttgtgactggcttctttcacttagccttatgttttcgagactcatccactttgtagcatgtatcttctcattctgtttaattggcgtccccattgatagtcttggaaaaggaatagcaaaataaacccctgtagcatttctgatagtgagatctttcctgtcttctctgaactttttgcaatagcatcgtagtgtttattcatagctgaaatactatcccccagctatatattactgaattgaagcaactcctgtagggaaagaagtatgtctgactactttatttttgtattttcagaacctaatgtggatctgacactccattctttgaccactgggcagaacttagtaagaaccatggctttaccaaacactagctatgggacctcaggcaagatgggcagttttgggggtctcagtttcctcactcatgaaatggggacaaatacttttgtccctatttttactgagtggaacaattaatatatgtgcagtggctagcacagagtaagtgctcagtattagtaagatgacatgttcatttttttttcccaagtttcctctaactgcctccctcactaaataacatgctccattatagtgtcttaaaattgggaatgaaaaagtgatgccagttacataattacattgttttctttggggcagaggtacaaaatagaattttattaaactttgcctctaatatttaaaaatatttttatggaaatttaaaaatgtacgcaaaaatgtacataactaatctccgtatacttatcacccagactcaacagttagtaatattttatcatgctgatttcatctactcccctacttgtttttatgcttgagaattttaaagctaattccatctatgaaatcattttactatgattccatctctgacaccattttactataaatatttcattatgtatctccaacatataaggaattttaaaaacctaactataataccattaacatacttgacaatattaacattaattccttattagtatcctgtctgtgtgcagtttcctataattatctcaaaattgtttgctttcttttttttgaaaaaaaaaaaatggttgatttgaatcagtatccagatgaggtctgcatattgcagtcaataggtacatcttttaaagctttttaaattttaagagtaccgcctctccatccatgaaatttatttatgaaataaattgagtcatttgtctggtagaatttttaacaatcttgttttgctagttatttcttaatgttgtcttttaacatgttgttctgtctcttacattttctgtaattggttctatctagaggtttgattagattcaggttcaattttctttggataagaagacttcataggcagtgctgtgagcttcctgttgcatctatcaagaggctcacaatgccacgttgtcccacttgcaaagcgaagggcgatccgtgtgttcaggtgttgtcagcctgatcctttcatttgaactttcttaccattcctcatgcagcagtcctgtttcttggctgtacattagaatcacctgggaagctttttaaaaatcctgaggctcaggccacaccccatatgaagatcagactctctgggagtgggacacaggcattttctaaagttacccaggaggggcccggcgcagaggcttacgcctgtaaacgcatcactttgggaggccgaggtgggtagatcacttgaggtcaggagtttgagaccagaccagcctggccgacatggtgaaaccccatctttactaaaagtacaaaaattagccaggcatggtgtcatgcacgtgtaatcccagctacttgggaggctaagacaggagaattgctcgaatccaggaggtggaggttgcagtgagccaagatcatgccactgcactccagcctgggtgatagagcaagactctgtctcaaaaaaaaaaaaaaaaagttacccaggagatacaaatgtgcagccaggcttgaaaccactgacttaattgtttcagtggccattgataatatttcattgattcgtgattccattcggtgttgcaatgtttgattttcaaattctatcattctttttgcatttattagctaggctgtttttataaaaaaggattttccctcatcaaccacttgattactctgacatatagtttatacaggaaagacagcataaatggctatctttctcttgattaattttcacaagttggtgccctaagcacttccagaggtgccaaaatagttttctttttagtatcaccaacttagggaatcttatgtatttgatgtgtttaaatttgttatgatcatcattcactgaagctcagattgtcccatcttggccaatgtggggctcttcctttagtgaattttgacatgaccctagttgtttttgaaagcatctttgcctcctggcacaagatattctctttaatgtttaacctctatttaatcataagctgttttgaacaatttgtaaatcagtgcctaaattagttctcccaccaatgaacagtatattgatttttttctgatggggaaagggtagcaccttactaacttgaaatacagcattttattaatgagcaaatttgcagaaatatctgttagagactgatgtaaattatcttttgtaaggggcagtagcttatatcaatagaaacacacgtaatatgtactccatggtttttgaaaacctctgcagtgttgcattttcagtgttgatcatcaagaatacaaatatataaccatgtcatacattttaaaaacaaataatgctagtgttgaggaatataactaatttcaaatttgtggaacagtgggactatattaaaagatgagtctgggtgtggtggctcacatctgtaatctcagcactttaggaggctgaggcaggcggatcacttgaggccagaagtttgagaccagcctggccaacgtggcgaaatcccatctctactaaaaatacaaaaattagctggacgtgttggcacgcacctgtaatcccagctatttgggaggctgaggcaggagaatcgcttgaacccaggaggcagaggttgcagtgagccaagattgtgccactgcactccagcctgggcaagagagtgagactctgtctccaaaaaataaataaataaaataaaattaattaattaattaattaaaaaaataaaagacgaaacttggaatagtaaatacttaaaaattctaacaatatcaacaggtagtgatagtttaaacatgtactgtaaaagtgtttggtttttaagggtatgtaagagactggttgtctgtgggactttgaaagcagttgggaaatgccacaatagcctcagtataaaattctagagacccaaagcggagagagatgcctcttaagaattatggaggatatttattacttttattcatgggatgggtggtggtgatttaatgcctgtctcttgtttcttttgtttttttttgttatccaaatccaaatccaaattatatgaggaattcacttaaaaatatacgtttagtttggtttaataaaaataatcagttttgatgtattgacttttaatttcatgggggaaagagtccattaggaatgttcaggctttctgtgtatattttgtgttgctcattctctttggcccaagatgaaactaatagccacaatgtgtctgctttggtgctgtctctagggttgtgtctgctgctgtcagctgcacccttgttatctggctgctggtcctgctcagtcagttgtacaggaatgtcatttccattaataaccccagggccggacaggcagatagtggaaaatgggtgaagagagagaaattgtatttaacccagtgttctgagttgtcatttttgagaccctagcatagctgggtaaaggcaagcagagggcatgacagcaaatctatttctggcagaatctcatatacaaactggagaaacagcctgataccaagagaagaaagggtgaaatatactgggaaaagagggaaagatttggggttggaaaagtcagaggaaacaatgttaggaagaaataacatgatcaagtattctgatagaggtgctgacaactttgcaaaataaatttaattttgattgtaaatgccatcatttgtggtggttcaaatgaacaaaattcctttttaaaaaatgaaatttatgtaaggattgctcatagaagattttggagttttgtgctatgtttttttttttttggttctggatcagtgaaaggcccgaggaacagagtaggttttatttttttttccatctaggtagaatgactcagttactgtagttgtctgtgttttggttatttattgctgcataacaaattaccccaaaacttgctggcttaaaacaagtattttattatttcctatgattctgtgggttggctgggctcagctgggtggctcctctgctggtttcacctggagtcccttaggcagttgcagtcagatggtggctgtggctggacgtccaaggtggcttcttcacacatgtgtctggcacctcagtgttcctcatgtggctttctcaacagggtgctgtggtactcctacagggtagctaagagtgccaagaagagaaagcagaagctgccggtcctcttaatgtctgttctcagaagtctcagaatataattgacaaataataattgtatatatatttttggggtacagtgtgatgttttgatgtatgtatacattatagaaagattcaatcaaactacttaacatatccatcacttcacaaacttatttttttggtaagaacattaaaaatctattattttagcaattttgaaatatataataaattattattaactgtggccaccatgcagtacaattggttactaaaacttattcttccagtctaattgaaattttgtgccctttaatcaaaatctcccctttccctatctctccccctccctccagcctttggtaactactttctactctctgtttctatgagaacaactttttaagattccacatataagtgagattatacagtatttttctttctgtgttttgcttacttagcattttttttctatttttctgtttggttgattaggctatttttcattattgactgaattatttttttctgtttagctcaagaccattgtatacatcgactcacagaagtatttgagtaagcctaatcattgttgaactgtgatggggaaaggattcagccttgggacacgtgacctttgtgtacaggtgtaagaaattcctactaggttttagggcccagaactggactaggccatgagggacccaacccatcctagtaggcaaatcattttccagttttatatttgagttcattagtaaataagtttactttccattatagacaccccctccactgacttatggggtcctgtacgccataaccaaagactcagtgttggaaaggtgatgctccactctgtgtctttgtttagctaaggtgaaggggacaggtctgccaccctggtatattctggtattctctcattggcagtcttagtgaaggctcatgagagcttcctcacagaggtttgtaaggattagaactgagtggaatagacctgttccagggcagagtgaagccgaggacaacagtgagattgtgtccttcagggccacagaccagaacctttactcaactctgatgttaagctataaagctagtttacaagtttatggaacaattcagcttgttcttccaggctcttgaaaatgaaggttaaggctgggcccgtggctcatgcctgtaatcctgtaatcccagcactttgggaggccaaggcgggtggatcacttgaggtcaggagttcgagaccagcctggccaacatggcaaaaccctgtctctactaaaaatacaaaaattagccaggcgtggtggtgcctgcctgtaattccagctactcgggaggctgaggcaggagaatcgcttgaacctgggaggcggaggttgcagtgagccgagatcatgccattgcactccagcctgggcgacaagagcgagactccgtctcaaaaaagaaaatgaaggttaagttttggcaaagtgatttgtatagatctgtaatacatcatgttctaatgaggtccaatgagttctaagtaatttctgatttccattaaaaatgattcatgaaaaaataagaatctcatcagagagagagagagaccacttttgaaatgaggaaaaatgacagaatagaaaaggagaaagtctcttttctctcttcttccccaagcccccctcatcactggttacttatttgagcatcctttatcagcatctaatgagaatgagaacatagtgggatgccatgtgaccttttgagtaggaattggaagctcttatgaagtttccagcctgatgtcacttcagatccaggtcattaatatttaaaaaaataaaaaaaataaaaactcttaggtgattcgaatgagcagccaagtttgagaagcagagccctactggagcaatgcttctgcaacttgaatgtacatgcaaatctcctggggacttggttaaaaatgcagattcttaataagtttggaggggagcctgagagtctgcatttctaacaagctcccaatggaggccgatgctgctggacaatggcctatggaccatactttgagaatatagagcagggggcagcaaacttttcacatatgaaggcctgagagtaaatatattgggctttgcaggtcatgtggtctctgttgcagcaacccaaatatacctgtagtacagagcagcaataggcaataggcaaacaaatgggtgtggctgcgtgccaataaaactttatttacaacaccaggcagtatcctgaatttgtcttacaggccgtgagccaataaaactttatttataacaccaggcagtatcctgaatttattttacaggctgtgacttgccaacttggtctagagctttccctgtctcaagtttttgagccgtatcttgcttcttccctgttttgttgggctgaatcttaggtaagaattaaatggttttgaaagaggttactcaatggctttgttgaactgatgaataattgatgatgacatttaggctctgtttacaaacagccccaattgtcccttggttgtggctcattgctttgccttgaatataggtggcctttctgatttctctccctagactgcctcttcagcaatggatcgaaacagagctagggtttattctaaaatgtggcccacgggcatctcagaataaataaccaggtctgaactgtagaggcagagggtggcttcaggtcacttttccttgacctgcattttacaactcatctctggtgttttgtctaaggcgacagaggctggtattttggctatctgagaggtagagagcagagaggttcctggacatgtacattttgtgttgagataggtcatgccccagatatggctattaatggtagcagagagttaaatgttgctgataatatattctaataagtagataatacagaaccaagttgtcagagttttggggggacccaaatttggaaccaaggactcaaagctcagaagggttccatcttgtgggcttcaggagtaaggtgcaagattcctggtctgctgctcatggtaaatttcctgcatttcaaaccccaaagtcagttaggcctaagcttcaggaaagttttcagtttaattggttcaaaactgaaacagactctcatctatctttatgacagtgctaggattcctaagggagaggtgttactcctcttctgaaatgggaggatgtgggccaggaatccttgggccagggatgcttatggcagactccatttctcagcatggttttggctgggaatttcctctatgagattgacccttctctccccgaggtgccattttctggaataccaccttctctctgctggtaaaatctaatttaccttagtgccttgactggtctgcaaaataaatgttctgacgtttcctgacaggagagcctgtcctctctgctttctgcttctttatcattcttgtactttcttgccttgccttttccattttgatcttctctcttggccaagtcttgtcttccgggggctctcagtcaaagtttagtcccaccgatgtccagaacagaaagctcagtggtattatttttagagagggagggagaacctcttaaaagcatacttaaaattctatctgtgtgtgtcttttcatccttacatctgagaatattatttgtcttggcatgttgaatatggttactaatgcagatgtggtctgtgccttacatgttattcagtttgatttataaaaaatgaataattatataatagaatatttaatcactcagaagataatatatgttgggaaaacatgaaatttgaagtcagattaaggctaaattaatctaggtgagaagttggttttggccctcattgcctgtgtagacttggggtgagttgcgctcattttctgagtcttagcttatgagctgtgaaatggggatgatctgtacctaccttgtacagttagggtaggatttggatctgatgatgaagtaaagtacttagcacagtacctggtttatagtaagggtttaatggagagcattacttttgttatttaaaaaattatgtctattgtttctgtttctgtttagctctgagatctcctcctctttgaaaatgtcctttccacaaggcccttcccttcccatccattccatctgaccctctaccttcttctgttgttttttctcttacatcgcattctctccctatgaccaactatgaactcctgaaggaaagaaatccagtttattaaactgtgtgtcttcactccgtctaaacacaacaacatggacaaatttcacagatgtgttgttgagtggaagaagccagatacaaaagagtacacactttttttgaagttcaagaacaggaaaaagtaatttatggagacagagatcaggatagcggttcttttgaaggtggaagggttattcactggggaggtacccaggggagtcttcaggatgctataaatgttttaaatcttgtctcaggcctactaacacagatgtgtgtatgttttaaaaaatatttgattggtatacttagtatttgtgcactttgtacgatatagtgcagtaaaaattttaaaagatgtttcccagtatgcagggcttatttgccttttagtgatcattcagtaaaaggttgaatatttaatggatgtcatgatgaagtaaatgatcaacttttttttttttttttgagacagggtcttgctctgtcacctaggctggagtgcagtggcaccatcatagctcactgcagcctcaatctcctgggctcaagagatagtcctgcctcagcttcctgagtaattgggactataggcatgcaccacaatgccaaactaatttatttttttgtaaagatggtgtctccctatgttgcccaggctggtctcgaactcctgggctcaagcccccaccttggcctcccaaaatgctgagattacagctgtgagccaccgtacctggccctaagtggttaatcttaatcaccatgtgaccaagaccaaattttaaggaagatgtagcatacattttggaaaacatggtagacataattcataatttatagccagaattcacgctgttgttcatggcgctacttggatcttcacatagctgtttcagaaaatatagtaaatgcgaacggcaggacttgcaatttcagacagtttgtgcagttggcaggacagagaacacagagtggggatacggtcctgtcagattggtggaaaacctcatttttaattgattgtctattgcatctatgcccctcttttcccaccctccctttgtccttttatcaattctacttggaaataaaatctgcaactctaatagatgctactgacactcgtgcagcaattctaccagatggcattcgaatctcgggtgttctatgaaaaatgaaaagaccaaacacatgcacaaataaatgaaggttgaattaatctttataattaaacggaatattaccctgctatgactgatttttgctttcaaactggattgcgtgctaatttttcagtgaactgtaattgtattaacatggcttttttgatgcctgaaagtacttaaaaatagattttgcgaagttactgagagaaaagttattagaacttttaatctaaacatctctaagatcctgaggtatatttatatcacgacttacagctgcaaagcattttccaatagttttttattctttgtcccttatcatcctgggatttaggtggcactggccagaaattgggttgaattgcaagtacctgaggcacgttagaaaattgatgtcctactgtgtacccacaaaaattaaaaataaaaattagaaaacaaatatgtacaactgctatgtacccacaaaaattaaaaattaaaaaaatgagtgggagggaaggtggtagagttttctacataaagtgcacctactagcttagtagtggtgactattagtgaaatccctaaggattattgaagcagaggatgagtcccctacttatgaactgataacacagtgttgggggttctcagaagtgggtccagaagccttggtaccatggcaagtaccatgatctacagcagagagtatctcaaatttcagcaggcatgagactcccctatagtagtggttttcaacccagagtgatgttacacacctggagacatttggcaatgtctggagatatttttgatcacaactggggggacagagggtgttactggcatttagtgggtagcagccaggaatgctgctaaatatcctacaatccacagaacagtccccagagataagaatgattctttcccaaatgtcaatagtgccaaggttgagaaaccctgccttatggtaaggctcattataatgcagattcctgggtcccagttcagaagcattctaactcaagagatgtagcattgtcccacaaatttgtgttttcaacaagctcccacgtgacacagatgctgccagtccaaagacaaagctttgggaagccctaagctagacgatgccagtgtcaaaggaacaagccatatatgtgggcactggccctatgacattcccttcttttagaaaaatgatatgaaaattcccacttgcattgattgattgattgagacggggtctcgctccgttgcccaggctcgagtgcagtggcatgatatcggctcactgcaacctccgcctcccgcatttaagcaattcgcctgcctcagcctcccacgtagctgggattacaggcacacgccaccatgcctagctaatttttgtatttttagtagagacgaggtttcaccatattggtcgggctagtttcaaacttctgaccgcaggcaatccacccgcctcgacctcccaaagtgctgggattacaggcgtgagccatcgtgcccagcccacacttgtctaatttaataattcaccaaagttatctcatttgatctctccccaccagtttatgagggaggtacttcacaaggtttttaggtggtaaagaattgttcatataagagctaaccttaaaggaaagaatgacaacaattcccacttaaactgttgatgagacaaggggatatgtttatctaggttaatctccaacttgcctcctgtttaaataagtaatttaacaactggaggaggattaagtagctgattaaatttctctgagaaacgttaggtgttagggccttggtatttattgcaggtgtgtttctaagccctttcaaccttgatatttgaaaatgtttttaaataatttgtaagtattttttcccattccccaaaaaatgcattgatttatttcatagtatttattcccattttggttaatatttctatactggctgtgttttaaatgtagatatttacctcaacaaaatatgaatattacagctaattatagaattatttaaatagttattatttaattatatatttctatcttgatgaaactttccgaaaagattaacctttgtgccttatttttcccttgctatctttactattggttttgaaaaatggggaaacctcttgtgtagaagaggggttggcaaaccatttctgtaaagagacaaatggtaaacatcttaggcattgtgtgggctatatggcttctgttgcaactactcaaactccactgctgtagcatgaaagtggcagtaaacaatacttaaatgaacgtggctgtcgtcagagagaaaaaagcaacttttcctttaccactttaggtttaatgtcagggcctgtgaattaaactataaaagatggattaacaagagaaaagcaaagtttattcactaacctgcatgagagcttacagaaaacacagcccagagaaacagaattggggggttacatattgtcttaagaaggggtagggttaggattttaagggacaataaatggtgggaaatgactgagaaatatatgaggggacctaacagaaagtcaggcttgctttagtaaggtctgtttatgtaagttctcatcctggcgccaactttttatccccggtgagaggagttattttcccccggtgcaagaagtgtctcttaaaagggggatttacgacagttgaattcttttggaagtctctgcttgtaggccgataagggaagcatggagaaagcctctttctgcttgtcttgattctcagataccttcagctcaaaatagtcctttgctacagtagcatattccggaccaataaaactttctttacaaaaaaacatgtggtaggctggcttgggctgtagtttgctgacctctgatacagagccctgtgagtgagacagagacaaacataatttattttggctcatataaaagcctaagtgtgatataggattgttcccactcttgggctgttatcattttggttatgtctggataaatgggcttagctaattgaggcttagggtattcatttgactaggtctagcagctgttctatttgcaaactttgtgagcagtttaaccacatataatcgaaaccaataaaaacattgatttaaaaatttatgatttggccactcttctgcccagtttcttttcatctttttttttttaatttaatttttatcatttgggacagggtctcactctgttgcccaggctggagtgcagtggcacaatcttggctcactgcaacctctgcctcccaagttcaagtgatccttctgcctcggcctcccaggtagctgggatttcaggtgcaagccaccacgcccagctaatttttgtatttttagtagagacagggttttaccatgttggccaggctggtctggaactcctgacctcaagtgatacacctgcctgagcctcccaaagtgctggaataacaggtgtgagccacggtgcccagctcctgcccagttttaaaggaaataaatgagccgggtgtggtggctcacacctgccatcccagcactttgagaggcagaggtgagcggattgcttgagtccaggagtttgagacaagcctggacaacacggtgaaaccctgtctatattaaacaaacaaacaaataagggaaataaatgagagttgcctctatttttaaggtaatattgctaccactctaaggacgatgggtgtgttgttttattaattaatcataaggtggctttggcttctaaaatctattgctactacctgctccatctgtttaccaagaaaactcaaatattactttctttctttaactctgttcagtacagggctcacccaagtaagaggagcatcacaaagacaccagggaaatgtttagtgccagtatggcaaaattaagatttacttctgccagagtagtttccttttgcagacagaagaaactgcccacctccaaaatatattgagttggtgttttaggagagagcatggatggtgcttgtttataatttggaacatgccttcctagaatgttgtctatcttagagagtaatgagggttttctgctatactggggcattattcacatggggttgagggtggatgacctgaaatctgatctttcctgtcttttacttcttgtacaattagaactgtgatttgcacttagagagccttctgattcatggaagtgcttatctatcttctacccctgtatgatgcatctgcttgtggaccgcacccaaaagcaatttgcagaattaaagtttttgaagactcataataaatcagttcaattttatcaagagaataaaatttgattcatcagataactgcattgttattatttgtgggatcctgatagacccagaggatattaaagcctgttcccctgactaattttcatcaataccattagctccgcttagggtaatatcttcagctaaggcatctatactagtcaatcatttgtttggcattatggaaactgccattgttttgaatgatagtgtaattcatgtacagtctcctgaacttctgggtgcttaaagctcagaattttgattgatgtttaatagttattacagaactcatcagagaaaatgaggccttggcatgattgagcctgactgaagctttcaaagccactgcaagcttaggaaagttgccctataaattttttatgaaagggcagtgatcagttgttccatttttttcttaagttggttaaattaataaaaaagaaaaaatatgctgagacttaaccacgtatactaaacatacagctatttaattaagtgattaaagtggtctctttgatgtgatacatgcaagacatttgagaatttatctgactctcctaaatagccaagtcagtggggattaaaataaatgagctttctgtcttcctttctgtagatcagcttaatagtaagtggctttgaaaattcaggagtaaagcagtcaacctagccaatctttaaatcagttcagtcacatatataaaaagtagatgccatttcagagctcacagctaaataaagcagaattatgcctgattctgttcttcccaccagcattatcaagttgtagtatacagtattgaaaattctgggaaggtgggggtgatttgagagtttaaatcatgttgtatattaggttttcaatgttcctcatttttctgagttcatttgtgatagctgttgtttctctcttcaaataataatctttacaaactctctgttgtctccatggaaattaattgtgatttttaaagctctagcactaagactttagggcagggagtcaactcccaagcaactgagatctgtcgcatgtaaatggtagtaatagcaaagagcaaagcaaaaacaaataaaaatcttgatagctaagccgtgcgtgcacgtgcacacacatgcacacagatgatgctgttgagcatggatcagtttggaagcattgttaagcacttactgtgtactagcccctgtgtcatgaattgaggcaactcagcgaataacctagctttatttaattatctgtgttggcttagtaagttatggcccttgggccatatttggcattctgcctgtttttgtgtgaaccacaagttatgaatggatttcacattttttaaatagttttaaaaaatcagcttggcacaatggctcatgcctggaaccccagtacttagggagggagatgtgggaggattgcttgagcccaggagtttgagacctgtctgggcaacgtagtgagacctcgttctccacaaaaaggaaaacaacaacaacaacaacaacaacacaaaaggacaaaaaaacacaccaagtgtaaacaaccaaaagaagaatatattatgatacatgaaagttgtatgagattcaaatttcagtgtctataaagttttattggaacagagtcacagccattcatttatgtgttgttctagcttgtttctgctttctcaggtacaatcacagagctgagtagttgtgcagaggccatatggattgcaaagcctaaaatatttactatttggcactttacagaaaaagtttggttattcctgatatgggtaaggcaaacttcataattcctttattatctgaatacttctcccaactctctattttactttattggtattagaactaaatgtatccatattctacagacgaggaacctgaggaacagagagattcagaaaattcagctattgctaataccttatgtgatgatgataacttgttatagaatggttttcctcagctttttaaataaaaatgcagttaagtaatcgataatattacgtttgtatgttctttcagcattaaggagagtcctgagccttgattttatgttcagtatgtgtattagtctgttctcatgctgctaataaagacatacctgggactgggtaatttataaagaaagaggtttagttgactcacagttccacatggctggggaggcctcacaatcatggcggaaggcaaaggaagagcaaagtcatatcttgcatagcggcaggcaagcaagagaaagcatgtgcaggctgggcacagtgtctcacgcctgtaatcccagcactttgggaggctgaggcaggtggatcacctgaggtcaggagttcgagaccagcctggccaatatggtaaaaccccatctccactaaaaatacaaaaaattagctggacatggtgtgggcacctgacatcccagctacttgggacgctgaggcaggagaatcacttgaacccaggaggtggaggttgcagtgagctgagattgtggcattgcacttcagcctgggcaacaagagtgaaactccgtctcaaaaaaaaaaaaaaaagaaaagaaaaaagaaagcaagcatgtgcagaggaactccccttcataaaaccatcagatctcctgagacttactcactatcaagagaacagcacaggaaagacccaccctcatgaatcaattacctcccactgggtctctcccatgacgtgggaattatgggagctacaatttgagatttgggtggggatacagccaaaacatatcagtaagtatttgctgattgattgaaatagcttacataaaatatatagttttgtttgccaccaagaattaattgcattggaagctgagtgtggtggctcacacctgtaatcccagcactttgggaggctgaggtggacatatcatttgaggtcaggagttcgagaccagcctggccaacatgatgaaactccgtctctactaaaaaatacaaaaattagccgggaatggtggtgcatgcctgtaatcccagctactcggtgggaggctgaagcagaagatgcttgaacccgagaggtggaggttgcagtgggctgagattgtgccactacactccaacctggttgacagagcgaggctccacctcaaaaaaaaaaattaattgcaatggattttatatcttgcttaattttccagaatgttttatatgttctcacaaaatatctcattttctccccttttttctctcctgtggtaagatcagttaatattgaaatataccttaatgttagctgggcatggtggcacacgcctgtgatcccagctacttggtaggctgaggcacaagaattacttgaacctgggacatggaggttgcaatgagccgagatcgtgctactgcactccagcctggatgacaccgtgagactgtctcaagacaacaacaacaaaacccagggaaacgtaccttggtgtgaacagcactgaatgatgtttatgattgtatgttaatcctcttatatttaaaggttaaatgtaaaatatagccttttatattttctgatactcttgatgacattgatcatagtgggtttatcaaattattcattatatgaattaatatttattgagtattggtcacttgctatgttacctgtggtaacatggtgattaggtggaataggctattggtttaatttgaatagtattagaagattctctcagctacaaaacctctcatttaattgtatttattcctttggctaataaactactcttttaaataaaagtatttctccagagtaaatatattagattgctattagtgacttacattctattataaactagtttgaggccccagtggcagctagtggattagcaaccttgaagaattaataattttgatggatgagaagggaagggggagatatctttggagcacagagtattgctaaggaaaggccaactagggtacgatggtattgcaagtggtatgaacacataggacctgctaggtgttgaaaggaacagataagagaaagagaaagaggaggaaggcagaaaccaagatggcaagtgctaaaagcaacctgtatctttgatcttttctagggttagatttggtagtgtttcttgtgtctgttttcagaggtgtgccaatagtggctctcaaaagagtcctccaacttttggggggctgcaaatagcctggattcttttgactcatatgcagagtctggctttgctaggaaaatctcctaccatgctccaagaagcttgtacatttgtcttccattgataagagggttgcctcaatagcttttctccctaagcatttcttttctcgatatttttcctctcaccacaagtgtggccttctgaaactggacctatgactaaaagagtgacattatttctcaggggtttcaggtgtttggttaggggtataagatgacctggactcttctggaagacctccaaacactacacatcacagttactccaaatccttggaaaaagtcacgtttctactttcttggtgtagtctacaactaacatttgctcatcatgtactctggaccaagggaaaaaagtgttttacatgcaatgtcatcctgaactcttgcagacaatgctatgaaataggtactaatttttagtaatttttttctcaacatctgatgtaaaggagagtgtgttaggattacattagctaatggaaaacatgacacataatgcctcaaacaaataagggctttattttctgtatgtcatgaagggaaaagagggaggcagtccaggtctaatatgctggccttcgaatgccatcagcttttcatcccaccatcttcagcatgtagattttttcctcatatgtgttgccttgtgattactagatggctgctcggcttctggcattgcatcagcattccagaaaggaagaagaggaaaggctaaagcagtagttctcagctggaggtgattttgccaccaggggcacatttggcaatatatggagatatttttggttgtcacaacttgcggaggggggcatgggttgctcctggtatctaatttgtagaagccaaagatgctgctaaacatcctacaatttataggacaaaccccagagcaagaattatctggcccaaagtgttgagaaaccctggactcgaggcagaaagcatatgctgatgaatctgtccccttttaaaatggatcattggaagtgcaacaagaagtttttcttaaatgtcattggcccgaatctcatcctgtagctgactccagttggaaaggaagctgggcaacacagctattttgttgttgttgttgttgttgttgttgagtccattgtcatcctgagcagaattggagtcctgacagtaagagaagaaagggagaatagttattaggtagacagtaggcggtgtttatttcaaaaagttaagtactctgcctaaggtcacagaggtagtgaagatcagcagctgcgtaaacctcctctattgaggaacggatgtccagctgtcaagtgcagcttctctctacatgtctgtatgaataaagcatgaaaatgcatgcactgggtatggaaagccctggagtttttgatcagccacaaacagcctaggaaatatttcttgcaggatataatatgcaatctgttaaatatttatatcactgctctctcagcatttacagtgggacttgcctttcctttttgtccatgtaaccaatagggtaattaatctcagacctgactcactaatactttgcccttcaagccatcaaactattggtgcttcacttctcccattttgaaaaattaaaaagtgatgtgattactatttgccttacttagggttcattcaggaaaccagacactcttctaagtatatcaaccagcaagacatttaatacagggaattggaggcttaggtaacctttcagagggctggggagtgaagggcagagtctgtcaatgatctctgctgcttgtacaccaaagaggtctttctcaggagaatgcctggaagttgctggaaaagggctgtatctgctgtctgcagatgcccacatatctgtataaggctaccaacagcaaatgaatggcatctcctcttctacctttggaattgcctatgagtgcttctcattggcagtctaacctggagccatgggatattgcaagatgtatttctgaagcttctcagggaaaaatgtagaatggggtggggtaggatgaggaggaattgacaacgaagtctgtggcagaaaaaaacatttgaatctgaatagaggaatacatatatagcatattttaggaagaagaacactctcttcagatgttggcaatgttgctactagtattattaccttattctaggtatgtatctttgggaggtaaatagggattctttgtatgtgttctgattatcttcaagtcatgatgatgctcaataaataataaaaaaggattcaataacctgcatagatggtgcagaaggtaatatattctgtgaggctctgtagtgcagtgggggtcccagagatgaggtttaaaaaacaatgcataattcaccagcatgctctggaaagaccagtcttcagaaaacaattgtggatgactcagcttgtccgttcgttcgttcttttcttttcttcttttcttttctctctctctctttttctcactttctctccaaaactatctggaattctttacttgctatagttatgcatatgacttatagcgagctgataaaatatagtgcaaaattaaatacaatgccggaaataatagaataatctcagaatgaggtaacctatagatgtatgacatagtttggtgttgggggtagagttgtaacctctagttatctgctatctgggtcacatcaagcttttagtgtgtgtaactcacagagttttgaaggtgtaatttgatctgtgctatacttgagtctgtgaaacagcaaaacccattatgactatgtcctacagcccttgtaaaatcctaagtcttgagcttcaggattctgctgatatttaatatctgaattatttcaaggaaggtaaggaaagtgtactatcttactatgtttatttcttgagtgaggaaaattgaaagggactaaaggaaagaactcgttgccaagagcagtgtccagaggtcactggttttgctttgtggctttgctggaataaaaccaacgtgtttggggttgcctaggtcttatgttgggtcatctggaggcagatctggagatgagaattcctgtgtaagtgattcattaaacaaatactcccaagagaaatcagtaagggaatgggagaagcaagacagggagggatgagagtccaatttcaggagacatctcagaactagtctgatcctgcagggaactttggaagtacaaattatacctcagagtttgtcctgaattgaggcaagggggctgggctttcatattgccgcttagggctgcttgggtggaggcagaggcggaggcggaggtgcaggtgcaggaaaagtgggtagaaggcaaataaacccccaggaactagctatttttgattgcaggcaaggagctctagtagttcctagggcaggccttcagaaagtctcaggtgttggccattagaaaagaaaaaacatagatgctggagggatgtacagaagttataaaagggatcccagggaatctggtcagagccctgacagtgtacttgtaagcttctcttttgcttttatgaaacccagaatctggagaagggagagagaaattttcacatggaactgtaaagtttctctaaagcaagggttgacgaactttttctagaaagggccagataaaatatttgaggctttgtgggccacagggtgtctgacccaattattcaactctacaactgtactgcagaagcagccatagttgacaggtaaacaaatgagtgtggctatgttccaataaaactttatttataaaaacaggggtagggtggctggatttggcccagggaccatattttgccaatcgctgctcttgaggttctttatatgtgcctaagtttgtttttcctttatttattccctatctgttataaaacacagaggataattagtacctttgtctatctaaatgatggttatgacattatgatgtatcttaaattattctagatcactgcctccaatctttctggcatcctggccatctttcacaatgttgcaaagataatcttcctgaagcatgactcatctccttttattcccatgctaaacatatttagctctctcttagctgtaaaataaaatataggcttgttaacatggcattcaggaatccctgtgatctgaccccaggccaattttcctgcattattttctgttctccatcctcatgtacttatagtccagctacattaaattactcgccctctctccaatatgccatatcgtgtgtgtttgctatctccttgtagtttttttcatttttatgtatttaaactgactatatactgtcaaaattttatatatatatatatgatgtacaacatgatgttttgatacatgtatacattagaaaatgggtaaattaacatatccatcacctcatatatttatcatttttgtggtaagaacatttaaaatctactcccttagccattttctagtgtacaatacattgatattaactatagtcactatgttgtacaatacatctcctaaacttattcctcttatctaactgaaattttgtatcttttgaccaactccctaaccccattcccccacccctggtaaccaccatcctactgtactctgttatgagtttgactgctttaaatttcgcatgaatgagatcatgcagtatttgccttttggtgcctggcttatttcacttagcatgaagtcctacagattcatccacgttgtcacaaatgacaggattttcttcttttttaaagctgaatagtattccattgtgtatatatactacattttatattccattgtgtacatatactacatttttaatccattcctctgttaatagacatttaggttaattccatatcttggctattttgaatagtgcttcaatgaacatggaggcactctctttagcgtactgatttcatttcctttggatatatccccagaagtaggattactgctttgtatggtagttacatttttaatttttagaggaacctccatagtgtttttcatagtgactgtaccaaattatattgccaccaacagtgctcaagagttcccttttctccacacccttaccaacacttgttatctcttgtcttgttgatagtcgccattctaactggtgataggtaatatctcattgtgtttttaatttttatttccctgatgagtaatgatgtggatcattaaaaaaatctgttgacaatttgcatgtcttcttttgagaaatgtattttcacgttattttccctttttaattttttaatttctttttttttttttttttggagacagggtcttgttctgtcacccaggctggagtgcagtagtgtgatcatagttcactgcagcctctacctcccaggctcaagtgatcctcctgcctcaacctcccaagtaattggaactataggcaggtgccaccatgcccggctttttttaaaatttatttttgtagagacagggtcccgctgtgttgcccaggctggtcttgaattcctggcctcaagcaatcctcctgcctcagcctcccaaagctctgggattacaggcatgaacaactgtgcccgacctcctttccccattttttaaccaggtgatttgctttcttgatattgagttgagttttaaatatattttggatattaaccctttatcagatgtatggtttgcacatatttttgcctctgtctttgcccctgtttcttctcctggaatgttcttctagctctacattttgaaatcctaaccattctcttaagactcgattcagtcaccttctccattaagcattttctccatgcagaaacagtctctcctctggactttgataacaatattgtctatttctattaaattttttattttgtttacattgtactagacagttatttgctacattcactgcatttttagtatactgaggtctctcaatatatatctatatatttttgcccttcacagtggcttgcatatagtagatattcagtaaatggagttttcagatgaagggcgcatttctacatcttgtgattattaatgatttaagtgctgaaactctgacattatttttctttttcctttttgtaggcgagagctgttttggcaaaagttggctatccagagtttataatgaatgatactcatgttaatgaagacctcaaagctgtaagtgctaaatttactgtacttttttttttctggcaagttttactggccttgtgcctttcaactaacccaagtcctagcaattaaaactggtgatgccagaaaacaccaacttttgattaattccttggctagatatgagcctgaatatgccaggcagatcacaagatttagggcagattcaaaataaagaagtgtcagaaacgatgcgtagctgagtgggtaccaaaaaacaaatggacttgggtttggcctaatttgatcataaaagaaagaattaagcaaattgagtatgttacaattagtgggcatgttctaatggcaaatgcatcatgtttgttgttaaatactttttatttgcttcattcgtattaaatgaatagtaataaatctgcctgctgggagttaacttcattaaactttatgagtgttttggcaaattaaatgcatatacatacgactctataatttattgtgaattggattgtgtatttgcagtaagttactgatgaaaaatggtcataattcttttttatttcaatatttttggacatgtattttccagtaggtgtattaattacaggcctttctattcacaagcactgttatttcctctcctacaaatagttctgataagtgatttttcttcctcatttaaaaaaacctgtttttactattcactagattttcttgaaaatgtagtcttttgaaattctttaagtaactatagttctgaggtatagctctttcctgaaattgtggttcaacaagtggcatatctgaaaacgatcccagctttgtagatgagcatcaaaattttacaagactattcaaaagtgagagaaagcattaattagaatcttcctccattgggctctaagatatagcctcccaaaatattgatacagttgctctggaagaaaataatgatgcctcatagcatcctaaaactcagtctatcttattatacactgttttgatgatgctgaaaatcccattattattatcgtaactaaaaatattgaagcacttgacatattcatgtacattatcttttaattccttcagtgattctgtgaaatagatgatgttcattcccattttgcagaaaaggacatagagactcaataatttaagtgagctcctcagttccacacagactttcagagccaggactgatatctgggctcaggaagctctgcctgtaatcagacaagggattcttgagggtcctttttaggcagctatgctggaggaacagaggcatcagggtggagacttggtgggggcagtgtgaccagggctgttggaagaagagcagagggaaggccatgttatcaaatggttaagagcacaggctccagtatcatgggcctgggtttgaattctgcttcttgtacttactagttatttcatcctgtgtaggttacttaacttcggttagcctccctttggttatctggctactggaaatataataaccaagtcttagtattgttgggaagattagatgagactgtataaatgtaaaagcacttggcataatactctggctcagagtatagcctacttcctataaagggtagctttgcggatcaatatggaccatttgtggtccattttcaaatcagccatataaaatattccatttcattgatccttaatagaaatagactcaagcgtgaatttctaccaattttggaaatatatctgtatcagccaggaaagcaaaaagcacagtaggtattttaaacagggaatttaatacaggaaatgggttggaaggcaagaaaagggaaaatagataaaccacaggttaaactgctgttgctactaagaagagtatcatcagggcacaaagtaccttagcaggagaacctgggtaactccatactattggtatatattctgagtcagcatgtggatgagaaggtttgagagacagtttgatgtagaggttataaatagggaccgtggagtcaaagtgcctggagtaaaacccccagtctaccatgtaccaccttgttacctagggtaggttatgtatcctctctgtgcctttcttcatctgaagaatgaaggtcataccaatccctcccatataggatttctgggaggatcaaataagttaacatatttgaagtgtttagaatgaaccctaacatacaatcagcacaatacatgtgttagctatgacatcctcaattcacacttgtggtagtgaactattttggtttgaaaaagtcctcatgaattaactcatgcactgtccaggtccctcaaattgatttaaaagggtatacagatggagcagtctcaagctttaatcgaataaggtagaacttaaggcttactcacaatatttagttgatcaagttttgttggcattctgttgctaagttcagagccccaaatttaaggacccattgaatgcaatatcttttgtgaaaagaaaccagatgccaaacaggatgccatgttggctgtgcttctttgtttctctggggcctgaactgaagacattacacaccaagatttttaatcacttctttgaagaaatggctttcatctgactcattgccaaagcagacacaattacgcccaagagttttaacagtttaaaaacctgacagtgaaaaaaattccaggtacatgaagtaaaaagacatttgtattcagaaaccgattgttttagtcaatttacacggtgctataaagaaatacccgagactggataatttatagaggaaagaggtttaattgactcacagttccacacggctggggaggcctcaggaaacctacaatcatggcggaaagtgaaggggaaacaggcaccttcttcacaaggcggcaggagggaagagtgagagttcaggaaaaaactgccacttttaaaaccatcagatctcatgagaactcactatcacaagaacagcatgggggaaactgcccccatgattcaatcacctccctcccttgacatatggggattacaagtccctcccttgacacgtggggattacaattcgagatgagatttgtgctctctcactttctctccccctcaagccccgcccttttctttttctgacagtgacttcagtccctcctccaaacctcagctctggagtggcaggcagttctcctctactctcctaagtgatggtaccatcacctcctcccttctgtgaccctagacacaggagtcgcagctgtgtactcctgtgactctcacagagccaaatcatatcactgatagagaaaatgaataaaacccaccctaaaaataggtaaaggatgatatgatagattgtaatattgtcactgagggcaatagcaaaaagactgaagtattcctggtacacaatgagactgttttcagttttaagaaacatgtagataaggactgctataggacctatgagaaatttctggtaatacgagctctgagcatgagaggctgttacaaatgaaaaacagcatgctgcatttgagacaggtggagatatgattcatcaggcacaaatgcaaaaggaaagaggagcgagattacctgatggatcagacgaaggtcaaggagaaatgttgaaaattgaagttgggctcatgtggaaataaaagcaaatgagatagaattaagaggtaaatatgcaaaggaatcagaaattttttaaggatgacaaggtaaactgaggtactcagcaaagcatttccgaacaacaatcttgtagtttttgaaaagaacaggaagaaataaaatgccctttatttgaacccccatcaacatgcaggaaagcctgttagcctaaaaaggtaggcatgagcccattttcaaatcagcctaataaagtattccatttcattgattcttaatagaaatagattcaaaagtgagtctctcccaattttggaaatatttcagtattagccaggaaagcaaaaagcacactaggtattttaaacaaggaatttaatacatgaaatatgttggaaggcaagaagagggaaaaatgagataaaccacagattagtaactttagaaagcagctgcgactcctgtgtctagggtcacagaagggaggaggtgatggtaccgtcacttaggagagtagaggagaactgccactccagagctgagctttgcaggaggaactaaagattcttccagagttattgtcagaaaaagaaaagggagggagtagagggggagagagagtgagagacagcaacacagcacccttttcccttctgcaacccactaatttcctgtagtgcctcctatttgcaggaagctaattggcaaaggagcttgagaaacagttttcagattcccagtccccagcattacggaacagagtgaaagggtaggcatgtagctgaaaaactacaggtaaataactggcactattaaggacgttactaaggaccaaagtcagaatcatggctggcctccatttacttaggagaattggaaatgagaaaattttcagaggccaaagtttctggtgagtgatacacacatatatagacataaatgtgcatatagggatatgcagatatgtgaacctatgtaagattctctgtggtgggtctggtctactttggccagtgaaacactagtgtgtgtgtgtagtgtgtgtgtgtgtgtgtgtgtacatgacagagagtgccactctgcaagagtgaggtgatattcagatggaatgctagaatgctgcagaaaaagaggttgttaaaatattaaaataattctttactatttgttaaaaaacacaaaacattgcgctcagctctttcaagggacccctggccatcatggcactggagagctaagggtgggcattggaggtgggacaccctggtgccccccaaccttccagccaggcctctgtaactctctcacattggccttcatccagactgttccactggtcagagcagaccaagaccagccccagtgtggagatgggacatctggttccagtgctagtgtgctggctggaactccctcagacccaccttcacatagctgtttgtaggaattgcatcctccatggtacactgtatatgtggattattaaacattttgagcatcacctcagtatatattaggttggtgcaaaagtaattgtggtttttgccattactattaatgccaaaaactgcaattacttttgcaccaacataataagtatgtctacatgtatagacacacattacttttgggcaaagccatctaaacacaccaatcttgcatgttgctttgttgtttgaataaggggacatgtagatataaaatacggattccattaagtattcagaaaatcctttgggtgcctaacataaagtctttctaatagatatttggatatatctctgagtatctttaaatggatttaaattaaatgaaaggtatcctagaatttacacttcctactggcacagtaaggaaagtaccacaattagtgcttcagtatttttcatctgcctattcctacatgtaggccgaagactatactacagatcatttgcattcctatgtactgccttataaacatgtacttatcctacagagaagctgaacacatttccttgttctgcgcttattacaggttctccatctttggggtggtggtggtggtaataactttattcttccatttagtctgtggatctgggataggatattcaagaagagaaatgtaggctctcctgaattttatgatcgggacagctgttcctgggaaatgacacaagaatcccaattaattccccaaaggtcacgcaattgaaaagtcaagagatggaattgattgaaagtgatcatcaacttgacctagactttttccagtaactgaaaggacaagaggcttttgagccaagtattgtctcttgccaaatttaattttttcattttggagattacaagcggctttaaaatattcatgcgaattcattcttgtttctacttctagaaaaaatagaactttctcaatagttgctgggtttcaattctttttctcatccaagggccttttgaaatatttaaaattatcaaaatattattacaattagcaagtcttctaaaagtaaaaactgatcccactgatattattttttaaaagttaatatttttgaaggaaattcttctgagaaaatttcccagaaagtgttctgagcccaagaacatatctgaattttctatcagttataatcatattctgaaggttttggcagaaaatttgggaactagagaaaacgcactcataatattgctacataatatatacttctgttacagtttattaatttgtttttctctatttctgtactgccgtaattgatgtttacatataatttggtacaccaacctttacagtaacatattgttttgctactgtctttatagcctttgttaccatgattttaactgctgtatagtatttcaagtaagttgtatcatgattgatttaatcactgcttctactcccttcctcaatctcactttgtccttgaatcactggttctcttattaagaccaacgaaaataacattggagtcagagccaaatgacttggacggtgtagctttgccaaattccgtaatctccttagccctgtttcccatctatcatatgtgaataacagtgactggcccctgcctacccccaaacacttaacctgtctcaaggaaaaacgtaagacctgtcctctattacttgtgatttccattaaataaatggaatagatcaattaaaccaggctaagaaagaagaaatattctcaacttaataatgaaaacaatttttaaattatctttctaaacataaataagctatggcaaattgtaattaattacctctgagttttgtttcccccaattattttcagggttctggtaggtccttacttatctaatgtatttttagacttgggacccttttcttctttacaacgttttttttttttttaatttttaggcagagtctccctctgttgcccaggctggagtgcagtggcacaatctcggctcactgcaacctccacctcccaagttcaagtgattctcctgcctcagcctcccgagtagctgggattacaggcatgtgccaccacacctggttaattttcatatttttagaagagacgggatttcaccatgttggccaggctggcctcgaactcctgacctcaagttatctgccagcctcggcctcccaaagtgttgggattacaggcatgagtcactgtgcccagccctttagaaagttttgagatggctttctgtttaatgtctgtagaccaacctgaatatcaagggatttttttttttcagatggaacagtaatgaaagtatcacaattagcaagttttctaaaagtaaaaactgaccccactgatattatttttaaaaagttaatatttttgaaggaaattcctctgagagaatttcccagaatgtgttctgaacccaagaacatacctgaattttctatcagttataatcatattctgaaggttttggcagagctgtcttggaaacaaaagctgaaaaaggcaaagggttgaacagtggacacatcttttaaccatatgatctgggaatgccttaggattgctagtaaggttgctttctataacaaggtgcttactctgtttcttctgaggctaaaagaaaacctttatcttaaaatataatcaattataagattttggccagcgcggtggcccacacctgtaatcccagcactttgggaggccaaggtgggcggatcacttgagtccaggaattcaaggccagcctggccaacatggcaagaccgcatctctactaaaaatataaaaattagctgggcatggtggtgcatgtctgtaatcccagctactcgggaggctgaggcacaagaatcgcatgaacctgggaggtagaggttgcagtgagctgagattgcactgctgcactctagcctgggtgacagagcgagactgtctcaaaaaaaaaaaaaaaaaaatatatatatatatatatatatatgtatgtatatatgatttctttttattatgaagcatttcaaatgttggaacatgagtaaaataatttgaacacatctattttaacacatagtaaacatattgccatattagctttgtacatgcacacacacattttaaatgaacagatgcatttgaaattttgtctgtaatcttccttgatctaatctccttcctctgcgtctatctccatctctgcatataaacactaccttgagttcagtcttattattgttattcccatgcctttctttatgcttttgctacataggtacgcatccatcaacagcatacagtgttgttttgcatgtttaaaaactttaaatttcctcatagatacaacttaccttattcactctgcataatttttaagattatttcatgttcatgcatacagaacaatcatgtaaactgttgtattgccttccattatgtgaatataccacaatttgtttatcagcccctcttccctgagcaagcagtttgagggacaatttaaagtcatagtgttataatttgttggccaagcagaacacagagggtgccaggaatcaatacttttatttctgcctttctccatgtgccttcagttattttactccttcctttatattttggcttggtctcctggaaagattgttaagatgactccttaacaaaaacttctccacggacatgagaacccactctgtgttagggaggagctaaatgtgagccagacattggtcaacaagtaggtgactgtcgagcctattaccatcaaattgcatatatacattcgtatctataatgtaatgccttgtgggtttcatatacacgagtattttactttttgcttttaaaagactattaaagttataaaaattacagtttataagaatttggttacccttggttatctccttattcaaatgtgtatttttcttaatttccatagtaatatatttaaaaacccaagcattggaggtcactacaaacgattgcatgaacagctccacagatcttatttacaataaatagctaggttaggtattgctagttttgtagatggagtgcctatagaatggaaaccgtctgccattctccttccaaaacaaggaaaggaactaaaaaagcaattatgtctgtttccttgtcttaatagacaacattgttgtgagctgctaccagctttctgtgttcccatgcaagctataatctatgatttgcctctgtaatttcattaatatttagtgaccagagactttttgagtgttaacagatacattctgttaataattattctggtgacttcattgtgcttatggtggaaaataggtctctgaatcacatttattgttttcctttacgaacaactaccaattatttgactaaatcattgtctataagctaaatgagttttcagccaactaaactgcatgttactgaaaaaacttacgtgacaaattaacaaagtacacattttaaaaaagatcaaggactcgtgagccaagaaatttcaaaccaaagataatatggtttataaaggttgaagtagatttttcaattagaaagtaaatggaacgcattgtaaatgactgcagcttctcttgttgtgtttttactgtgatccagaaatgactatattgatttttgaagtttttacgttaacaaaatcactgagactaaatttcatggctttgtgacttctgggtcaactgataacagctgagagaggctgtgactgatgcagcttctctgctagttgctccttcctatgctgaagtatttttttagagccatcttttatctttacttagaacaatgatgttgtggtttgttttattcagatcaagttttcagaagccgactactttggcaacgtcctacaaactcgcaagtatttagcacagtctgatttcttctggctaagaaaagccgttccaaaaacagagtgagtattaaacaaaaaaagttaaatagataaatacattggtgagaagcggagtctctttagattaaactttgtaattcccctcaagtcagagtagctggcttgccagttaacttgttttagcaaaatctgtgtcatgttttgccaactcttattttttatattacgtgattcagatcttaagtctaattacaggtcccccatttctagcatcaacacatatcaagagaaggcttattagaatgcaaacattaaagttatgtctagatctagttatgaatatatagagagggaataatttctctggatttttacattcatgtaataacttttgaagaccttaaaaaagaataaatacttaaactatgattagaaatgtcaaagtaaatgtatagaagcaactagaaaatatttgttgaggtaatgcctatcaaagaactgatagctatattgtttttatctaatagcagttatgatttatttgccttcctctcagctgcctataggagtttttcctacagataggagagtttccttaggaacttttaggcccagagcccaccagctacgatttcatcccttagcaaaatgtcagtgatgaatgtagcagctaacaattattatttgtttacattgtaccagaaagtgctttacaatttttaattcattttatcctcatacgaattctgtgtggtataggtactgttatccccattttacaggaaaataaaaggcttacaactgagaaattcttcagcttaggtttggatcacattttgttctgtctgctggtgcttttgattcctgggactggattctgttctgctaaggcccacttctccaatgcttttttttctctctgttctccagattggataatttctattggtctggatttcaactccagaatttctttttttaatttaattgtattattatttttttaacttattttttatttcaatagattttgggggaacagatggtggttggttacatgaataagttctttagtggtgatttctgagatttcagtgcacccatcacacgagcagtgtacatgtatactgtatcagtgtgtagtcttttattcctcacccccctcccactctttccccctaagtctctaaagtccactgtatcattcttatgcctttgtgtcctcatagcttagctccctcttatgagtaagaacatacaatgtgtggttttccattcctaagttacataggataatggtctccaattccatccaggttgctgtgaatgccattatttcattcctttttatggctgacaacttcggaatttccgtttgttttttgtagtttctatttctctgttgtgattctttgttaagtcattgtcatcatattttctattaattcttcaaataaagtttattttaattctttgaagtcatctataatagtcactttcaagtctttgctaaatctaatatgtgggctcaaactaactagagttagtttctattgattgcctttttattaaattaattaatttttttttacagtttttcctttgcttaacattttttgttgttgttgctaatgacagtttagatagcatgttgtagcaactctggattctgatttatttttctgaggctttttttttttaaaatcaaaagtaactgtcctaacttatactgccgaatagatcttctctgtggtatgtagctgtcgatgtctccactcagttttttaactcttatttgtagttattagcctcacttcctgctggttgtccctgtgtctacatagcttagtgctcaatcagtgattaggtcagagcttgtgcttaaacaccttgagtccatagggcttctaccctctgccagttgctctgtgtgtgggttgggagcaccttcaaagttatagccagttctcagtccaccttcaatttcaccttccaccaggccctcactggtcttccctgcacatgtgcctagtttcccagtcagccagggatgtgtggagtgcttatttggcccttctattactatttcagttataggatctctcttttaaatttctgactgggttttcctcgttagttttctactaagttggccattcaaaaattaaaaaaaaaatgttgtgggtatgtagtaggtgtacgtatttatgaggtacatgagatatttcaatacaggcataaaatgtgtaataatcacatcagagtaaatggggtatccatagcctcaagcatttatcctttctttatgttacagacaatccaattatacagttttagttatttttaaatctataaaaagttgttgactgcagtcaccctgttatgctatcaaatagatcttattcattctatctaagtatatttttgtacccattaaccatcccctcgacccagtacccttctcagcctcattctactctctatctccatgggttcaattgttttcatttttagctcccacaaataagtgagaacatgtgaagttttctttctggggctggcttatttcacttagtattgtctagtttcatccatgtagttgtaaatgacaggatttcattcttttttatggcttaattgtactccattgtatatatataccacattttctttatccatttgtctgttgatgaacacataggttgcttccaaatcttggctattgtgaacagttctacaataaacacgggagtgcagatgttccttcgatgtactgattttctttcttttaggtatatacccagcagtgggattggtggactgtaaggtagctctatttttagttgttcgaggatcctccaaactgttctccatagtggttgtactaatttacattcccagtaacaaagtacaagggttctcttttctcaacaacctcaccagaatttgtttttgcctgtcttttgaataaaagccattttaactggggtaagatgatatctcattgtaatttttgatttgcatttctctgataatcattcatgttgtgcaccttttcatatacctgtttgccttttgtatgccttcatttgagaaatgtctattcagatctttgtgtctatgtgtctgtttttatgccaatatcatgccattttggttactatagctctgtagtataatttgaagttaagtaatgtgattcttccagttttgttgtttttgctcaggataacattggctattctggatcttttgtggttccatataaattttaggaatttttttctatttctttgaagaatgtcattgatattttgatggggattacagtgaatctgtagattgcttttggtagtatgggcgttttcacagtattgattcttctaatccattaacatggagtatctacttttttgtgtcctcttcaatttctcgcatcaatgtttttatagttttcattgtggagacctttcacttctttagttaagtttattcctaggtattttattttattcgtagctattgtaaatgagattatcttcttgacttcttttacagatcgctttctcttagaatatagaaatgctactgatatttgtatgttgattttgtatcctgtaactttactcagtttatcattttaatagtttttttggtagaacctttaggtttttccaaatataagatcatattgtctacaaacaagggtaatttgacttctttctttctaatttggatgccccttatttccttctgttgtctgattgctctagctaggacttctagtactatgttgaataatagtggtaaaagtggacatccttgtcttgtctagatcttagaggaaaggctttcagtttttccccattcagtgtgatactaactgtggctctgtcatatatgactattactgtgtttaggtatattccttctatatccggtttttcgagagtttttatcctgaaacgatgttgaattttattaaatgcttctttagcatcagtttacatgatcatatgccccgtgtttctttccactgtgataggacagcactgagttccagtgcaaagtcccacaatcaccgtactctccttcccccaagcgcagaggtttttctctctgtgcccatgtggctgctgctggggaatgagggaaggacggtataggcaattcaagactggctttcctaccctcttcagtgcctctttccttgatgtgatgttaaaaccaggtattgtgattgttcacctggattttggttcttatgaagatgctttgtgtgtgtgtgtgtgtgtgtgtgtgtgtggctagttgttcaatttggtgttcctgcagggaggacacttgctggaggtttctacagccttcttgctctgcttcatcctctatgttggccatttttatctgacaaagctgtggcttttcactgccacccccagttgagtctacccactggggcagcaaagctgctgatttcccagccagcctttttctgacaaaactaaggtctcactgagctaggagggacaggagtagtctcaggcaaaaaggccatagtgcctgctctacttaatgccaagttctagcagtttttaaatattaaattttgtttaatttattgctcccccttgatgaattcccagattcctaaaatggttatttgttgacaatgttgtccagttttgtacttggtttttgtagaaatgatttgtcaaccttctcatgccattatacctgcaagcctggcttccatggattacaattttttttttcatggcccactttttaaccttggctaatattctgatttctagatctttgactggctgtttttatgctgcctagtcttttgctactctccctttcaagtccctgttctgtcctggcttctagaaactctgagcccctgtgctttcccttggcttaagtggtgattaccacttctccctcttatgtttccatccggccatccctgctctctgcccttcaaaccttcctataatatgcacctgaaaaattcattggaggttactgactttaagaggtaggcctaaagctgaatctctcccctacctaaccctgactccagtcaaaagcacaaaggaaaacagctttagaactgctttgaaaaatgatagataatggtttaaagccatttgctccactgtctttggttctttcctctcatcacgttatttctcagtccacctatcctgtttcattcccagtctaaattattcaatagttttagatttaggcttcttaaatccaatactcaaatctgatgactttggcaaatgatttccagtatccctatgaccatctacatgtaatacggtagtcacagatctatataatcttgcccttcaatatttgcttcagatcagttccaactcttttttaaaaaaaaaaatctgtggaaaattgaagggtttcaccaattttttggtgaattttcagggtcttctcaggggctcctgcatattggcaatacagtcagtctaattgtttgatttcaaaatgtcattattcatttagttgtgtagaaaggcctggattagtaattgaaaaactcctaaatgtgttatctttaacatcgtcctaggatactgatgaactttcagattctaatggtcttaactatttctaatattttattcatgccttagaaatatactggctttgcaggcttaggcaaactgagatttgtgtggttttcttttctgtcattgaaaaacaaatagctctttcacaagggtattaaattggttaacttttgggaaaagttctccagaaatggaaatcagtgcaatgcttgtaattcttgtttcctcagactatatgtctatttcagggaaataacatttagaaatttaaggtcttctttgcatagtaaagggatatgagtaaattccttttccttcttgttttttttttttaaaggaaacatctggctggaccttttcaggcattgtagagacttttagcctcatgatactcattggcttgaatggacatctttcaggtctgaaaattcatgagttaatcgagtggggatcattctggagtagctctactacactagtttactttgaacagcatcatgattatattttcacaaagccctgaaataacgttttgcttctttgtgggtgtaggagataaagaccctttatcttttattctcatggaatccattttagctgcactaatgtgcattaagaagtttctaaggcgatgggaaatgtcagcaagaatgaaattaattgggtggtcatccctgaaggtacatatttaggggttggttcacagaattgtcacttcatcagcttgcttaaaaatagaggatttacttactgctcggcttgagttgaaagtaatttctttccctcaggatcaccttctttgacagaaattattttagcccgcctcacttttaactcactctcattctactgagaccaaacacgtctgaattctctatcttttgaaaaatatgtaaaaatgcattaaatgtctttataaattatgttcctgcccagaacttttgtttgcaaaagcattatctatagcatggaatgtgagtgatataatctgcaggatattaataagaaagcaataaatacactattgcttttccattccatattccctagactatctgtaggagttgataagaaaaatgtaaaactttagcctgatgtatatctattttatatggtccaaagaaataggtgtaccaatgtctttttcttcagattcttgtattttggtattatattccttttatgtatctcattctccagtataatttcatccccattattgtgggatttgaaatttctatgagacctctccttaccttatccaccaaatcctttctcaaacacagactgcagaagcaccctaaagacatagtaagaagaatttaaagcacttgaatgatattctctgtttattgaagtggatgtatacatgcaataaattcattttaatggatttagtgatcttctgttcagcacttaccatttggacaacagtcaaagcccataagcaacttaaaatcttgttgggacataagctgtgcaaactcagatgccttcaggggccagtcagttaacaaatggttgacctacatgggtgtaaacaacagggagtggtagggactgtagaaaactagtaattacacacaccacttgaaggaattccaattcaatagtttgttaagccattgtgttgggcaagcaaaacagttttctgggaagattcagcccattgggttggacttagtctgtggatagccaacttttcagcattccatttatctattgctgtgtgataaacctcccccaaatttagagtactgaaacaacagtcattatttttctctctcatggttctgggggtcactaggctcagctgcatggttctcgtttgtggtttttttttttttttttggacacagagtctcactctgtcaccaggctggagtacattggcgtgatctcggctcactgcaacctccgtctcccaggttcaagcgattctcctgcctcagcctcctgagtagctgagattacaggtgcccgccaccacgctgagctaatttttgtagttttagtacagacagcatttcaccatgttggccaggctggtttcgaactcctgacttcaggtgatctgcccacctcagcctcccaaagtgctgggattacaggcatgagccactgcacctgaccatttgtggtctttcatgtagttacagtcagatagtggctggggctagagtcatatggaaggctacctctctcacatgtctaatggttgatgctgactgttgactagaacatctacatatggcctcttcatgtatgttgggtttccttacagcatgttgattgatatagaaagttcaaagagcagcttttctgagaaagaagaagggagggagggtgtgtttgtatgcatcagggggaagttgtatcacctttaattacctagccttggaagtcacactgtcatttctgctgcgtattattctttagaagtgagtcactaaggctaacccataatcaaggggagaggaatttagattccatctcttaatgggaggagtgtaaaaaagttcacaaacacatattaaaactagcacatgtagccttacattagagaatagtaaaactaaatatataataaacttggatgtaatacgggagatatacaaaatgtttaacagctggtttggcatgggccctgaacaaatagaagaaataacagcatcaacaactggtaggatctactggtgcagctgcttaatatcagctctgggtattatcaagtctccatacgtgccctagagtcaataagagccctgggaggtcaggaatggtaagatcatgtgtctgaaataagatgttttcgttattcttgttgaagcttcagaagccccattaaggtctagtttcagagactggttgtttggtttgctttgtctacctttgtctaccagcagttaggaacattttccctgcatggcccttacctgaatattttaaaagtttgttattttaaagagaggggagttgggaagaacaaaaagagaagggacaagctctaggaatacacgttatcttttgtatgtattatgattcattccagtgttatttagaagccaaggcacccacctggattttcccctcttgacctacaaatgttgggttctttggatagtgcattagtttcctattgctactgtaacaaactcctacaacctaagcagcttaaaacagcacagatttattatctcacagttctctagctcagaagtctagggtagcttggttgttttctctgctttggatttcataaggctgaaatcagagtgtcagccggctgggctcttatggggaggttctgggaataatccccttccaaggggattcaagttgttggcagaatccagttctttctgattgtaggggtaaggtctttacttccttgctggctatcgcctggaagccactctttgttctcagagggatttatgcagtccttgcccattgcccctacatcttagagccagcagcgtgtcaaatccttcttacccttcctcctctccgacttcctcctctgttgcatctctctgattccagccaaacaaggttgtctgcttttaagggcttgtgattagattgagcctacctgaataatccaggataatctctctattttaaggtccttaagcttaattacacctgcaaagtccttcttactatgtaatgtaacatgttcataggatccagggattaggacttggccataattttacctactacaggtagccaagttaggtcaatagaggtgctttccccttcacttgtttcctcaggaaagtaggccaaccagcaagtttatgttaaacactagggcttaattgaaataccctaaatttgaaggaaaagaatatgcattttatggaaatatgtctaggtttcggttttgaagagagaagaggtgctctttcttgatttccagtaatgtctacagtataatataatgcttaggcgaactggtttgaagtcagacagaccaggcctcgtacaagcacataatgctcataaatctcattatcctcgtctgtgaaatgggctaataattcctatgttgccatggggaaaaactgatgaatagaaggtgcttaggacatagtaagtgctcaatgaatgttagctaaatataatgataatgataacagaatgacatattcatagacttctttgtagctggggagaaggtatgagtttaccaactagtatcaataattgggtttcctattagtttcatattaacctgatataaattaatttgttagtctgacataattatcctattagacgtaaatgagtaatacaattattctagaaagggatttatacaagttttttttttctttttaatttttttagagactggaacttctgggctcaggcagtcctcctgcctcagcctcccaagtagctggaactatatttgcatgccactgctgggcctaggagtttatttttagcaattttgcttaagatgaattgcttggttttaatcataacaagcagtcactgaaactcacaaccatctaagtcagggtttggccactatggcctgtgggccaaatctcacctgctgcctgtttttgtgtggcccatgagctaagaataatttttagagataaatgtttgcaggtggtttgatgatggggaagccctaactttgttctgttttttgtttttgttttttaattaaaataacttttgttggtacgtagtagttgtaaatatttatggggtacatgagatattttgatacaggcctgcaatgcataatcatcacatcatggaaaatgggagtatccatcccctcaagcatttatcctttgtgttacaaacaatccgcttatattattatagttatcttaaaatgtacaattactattgactatagtcaccctgttgtgctatcaaatactaggtcttattcattctttctaactatacattttttgtacccattacccatccccacttctcccccattcccctaccgcccttcccaacctctggtaaccatccttctactctctatctccacgagttcaatcgttttggtttttagatcccacaaatacgtgagatctcacaaatacgtgagaacatgcaatgtttgtctttctgtgcctggcttatttcacttaacataatgacctccagttccatccatgtgttgcaaatgacaggatatcattctttttatggctgaatagtactccattgtgtatatgtaccacattttctttatccattcacctgttggtggacacttaggctgcttccaaatcttggctattgtgaacagtgctgcaacaaacatgggagtgcagatatctctttgattattttctttcctttgagtatatacccagcagtggggctgctggatcatatggtagctccatttttagttctttgaggaacctccaaattggagaagcataactttgaaccccaattaagcaaaaggttatctcatcccaaaataattccgttattctcattaataggcatatattagaaataattgtactcagctgggcatggtggctcacgcctgtagtcccagaactttgggaggctgaagtgggtggatcacttgaggtcaggagtttgagaccagcctggccaacatgccgaaaccctgtctctgaaaaaaaaaagagaaataattgtacttgattactattgttattttttggatttcatcaataaaatttgtggacagtttgctcttaagtacctacgtaatatccttgattttgcctctttgcctgtaaagcctaaaatatttatgatctcactctttacagaaaaaaatttgctgactgctgatcccagtaacctattgtgcatttaaggtttgggtgtagactccttttagatagaagggatcctttagatgtcctaatgcaatgccttaattttatagctaaaaccaaaccccaggaaggtaggtgactcttcccacacaattcagctagttagtgatagaggcagtacactttccactggagcaggcagaccctctgggtggcatagttggactttattcatctttctttaaatggacctctgtgttgtcaccaatccagaacttttaaatggacaggccagaggtaatgcagcatagaaacccaattgtccattcaacccattgaatagggcctggcaaatatatagttgctgtgtttccatttgcagggacagccctttagattctagaatttctctttaaaactttttcaaaagcactggtgtgctgactttttttctgttaagttagtaacaataaataactgggcatgttaatatattttcattgagccatgttcagtttaggatgagattgttcattgagcagtacagtagccccaaactgagggaataatttcccctcatgtccaacatccccattgttccatgttatctgctaataaacccagccatgctgtgtttgtctttgcttccctcctgcctgtataatgatgattgctctctggcatttgtttctttttctacaggtggtttacaaatccgacgactgtcaatgccttctacagtgcatccaccaaccagatccgtgagtacgggttccttgtctccttggtaacctggtataaaatgcaaagaacttttccatgactatgatggagggtaagacatttcttatttcccccaaaagtggcagggtatgctggtgaaggaaggttgttctcctacctatatgccaaattttcctcactctcttcaccttaccagttttttttaaagctttatgtcaccactgattgaaaaaaagtcaactacagtaaaccaaattaaaccataatgaagtttgccatgaaaaggagcaagtttccactttcctttcataatggccttactgattttgtccatgccattttattcattcctaggattggtggggaaaacagcaggtaactgagcagattgtagaacctgagcggaccatctgtatgtaagaaagaagcttggaaatattcttattaacgctaggaagttatgtcttgaggttttctacttacatgtatcaggtatatgtaattaaaaataccatgataaatttaaaaaattattatttttattattttttaaagacagagtctccctctgtcacctaggctggagttcagtggtacgatcctggctcactgcaacctctgcctcccaggttcaaattattcttgtgcctcagcctcctgagtagctaggagtacaggtgtgcaccaccacgcccagctaaattttttttatttgtatttttagcagagatggggttttgacatgttgactaggctggtctcaaactcctggcctcaagtgatctgcccaccttggccttccaaagtgctgggattacaggcgtgagccactgcacctggccttaaaaaattattaagatctgaatggcacaaataaaaagtctgacagcttccagccttggcaataaggacacatactcactgctggtggaaagatagatgggctcatccactttgcagggcaatttgacaatatctcaaaaagctgaagttgtgcatgcatacctatgaccatgatgtgtgctcctggaatgtgctctaatgttgtgagtcttgaaatgtggtccttggacctgcagtaatagcatcatgggggatcttgttagaaatgcaaattcccaggccccaccttaggtctattgatcaaactttggatgtggagctcagaaatctggtgcaataaaacctgcaggtgattgtaatgtatgctaaagtttgggaacagctgccctagagaactcttgcacaaggcataaagaagcccatgcaaaaatgctcataacagtattatttataatagtagaaaaagcaaaataacctacatattcctctgcaggaagatgagtcacatgtggcatattcacacaaaggaataccatacagcagtgaaaaatgagcaacatatattaacatggatgaatttcacaagtaaaacaacttgggaaaatatatcaagtatgatactatataaataaagttgaaaatcatgcagaacaattctacacatggtttggaggtccatccatttgtagtgtaagtgtaaagacattcatgagaatgacaaacaccaaattccggttggtggtggcttgtcttggggagggtgggccactgttgctcaaatccttgctggtttctcctcatctcccatatctcttaatgatggcatgccccaaggctcagtctgcaccttttctgttctcttctctccatctttgctcacttgcttggtgataacatctaatctcatggttttaatcacatttctacagtgttgaatgcaggggatggaatttatcacccttgttcataccactactatctcccacctggattatggtaatagcctcctcattggcctccctgcttttgttcttaccccccttcagtctattctaaatataatattgtagcgattttaagacgttttacaatcacatcgtgtcacttctttgctcaaaagcttttatcagcatcccatctcactcagagaaagagccaaattatttataatggccttaaggtctgttatctttctgcctgtacctcctgctactctcccccttcctccctccttctgttccggccacactggcctccttcgtgtttatagagcacacctgacacgctctgctctgggagcatttatacctggggttggctttctcttggaaaacttccccaagtgacctgcctggtttatgctcccatttccttcaaatctttattcaaaggccaggccacctccttagggaggcatcctgccttccctctggccagttggccagtctgccgtgggtcctccatactggccgttgttcctacaggactctggtcagaggacagccggaaggctgtggctgctcactaccagctggcacatcttcttagagccgccctcgtgtggccactgttaggaatggcagtttctgcccgacttcggtctgagagagaaatgaacagaaagacgaaagacaagcagatggcgggatttttttatttatacattaatttacataaccaagtaagttgttaaatattttgaatgtcacttcttactgtataaatattcattatcacgaaactaccattgctttcttaaggccctaaatgccaacttgagaactaagttgcatatgttatatgggaacttatgatatttgagttattaattataactaatacttataataatttattattaattataatcacatttaggacattctattgggaaatagaaattgtttagattattcacttaaaaacgttttattgtctaatatttggtacatgcaaaagaacatgtaacattttggcacatataagttataaagaatatatgaaaacatgacgaaattaatatgtgcctacgacgccctcaccccatcaggaaccatccctccctctcaccacagaagtaacactcttctgatttgagggtttatcatttttgttttgtttttttaaaataaaactttatttatataggtatccctaaagaatatgttgtttatttttacttgtttcttagtataataaaaatggtatcttactgtatgcaatcttaaacaactgcgatttttcagtcaacatgtttttaggatttgttcgtgtagcatgtggtggtaggttgttttcatgttcactgctgtataatatttcatgactgtacccccagattgtttattcttctgttgtccagcctatgagtccccacacccaggtttttgcttatgaacagtgctgctctgcatattcttgtgaatgtctcttggaacaagtgtctgagggtatacatccaggagtggaattattggctgataggaagaagttatctaccagataatatcaaatgttttccaaagctggtgttccaaagtacagaagtgtttctgttgttcctcattttcatcaactcttggcattggtagatttaattttcaccagtctagcgagtgtaagagatcagctctgatgcaagaaaagccgacgtttccgcattcactttaaaatgtcactgaaggcttactgctccttggggtacttaagtgtgtctaataatagttccatctccagggttcacccctgctcagcctttttcttgcctgggaagggctaatcctatcagaggtttactgaggaagaaaccatttcagggtaacccaatggtttcatgaaagctcatgggcagagggttttttttaaaatgaacaatttgaaacagtattttaattaagagattcaagctgtttctgttttcctaatgaccagtgcttgctctcattgtaaattacattcccaggcaagatgacaaggaatcctttgggtgacttttttttcccctctctcctttctgattttctggactacaaattaagacaggtggagtttcttcttacacacttccccaccgggtttcctgggacttcccccaccctacaactgccttctttttgcttcgctgaagaagtgaaaaattgaggtgattctctaaaatgaacatctttattgattaggggctgattctgacagcatgtggccatctgtttaattgggttttacatctaagatgtaactatacttagtaacgtgatttatgacaatttcattcagttcccattatcattttctgatttatgctacttaaatcttcttctgcacgcaatagagacttgaatagaaaacagaaaaacctgtagttgttttttctttttcaaatccatgcctttgtgtggaaccctatgatttgtggccatctttcaatgttagatttttacagggtggttacaacttcttatttttcttcccttgtcaagctgggtagcaacgtctctagacatggcatgtagtgtgaaattataatgatttaaatctgctgtatgaggagttaaactcagtagctgtcataaaatttaattatatttgaataaggtggttaaagaggaaaacacaaatctgaaatgattggtgcttaaccctaactttgtgataactgcgacactgatcttgctgcttttcagagtggcaaggtgagaacatgaatcagagatctagtttgtatggccttagtcgaggtttttatccttccagacccctattgtcctgtctgccacatgttgaggctatctagcccatagggttttaggggaagatttaatgagacgaatttgtaaagtgccagcacattgccaagctcagggcttgtatatctaaacctggcatgccaggaatccctgcgataaccattgtgtcacaagacaaacagcaaaatataaagatcggcaggggggattatttcaaacttttgccctcaagagatcttaggccgggcatggtggctcacgcctgtaatcccagcactttgggaggctgaggcaggcggatcacctgaggttgggagttcgagaccagcctggccgacgtggtgaaacctcatctctaccaaaaatataaaaaattagccaggcttggtggcaggcgcctgtaatcctagctgctcgggaggctgaggcaggagaatcacttgaacccaaaaggcggaggttgcagtgagccgagattgtgccagtgcactacagcctgggcgacagagtgagactctgtctcaaaaaaaaaaaaagagattttattataatgttccacattataatatgtatgcatgcaactgactaaatgctgagtaaaagaagccaggtgtaagactaaatactgttctgtttcatgtgtataaagttcaggaacaggcaaatacatctatatgatagaagttaaaataatgactacctttgttgggggtattgactgagaggaggcatgtgacacattctttatcttgatctcagatgtggttacacaggtgatacaagagtaaaaactcaccgtgttctatcattaaaatttgtgtctggctgggtgtggtggctcacgcttgtaatcccagcactttgggaggccagggtgggaggattgctttaacccaggagttcgagactagcctgggccatatagcaagaccctgtgtctacaaaaaacaacaaaaaattagccaggtgtggtggcatgcacttgtagtcccagctactctggaggctaaggtgggaggattgcttgagcccaggggtttgagacagcagtgagctatgattatgccactgtactccagcctgggtgacagagcaagatcctgtctttaacaacaacaaaaatgtatgcttttactgtatgttaagtgacacctcaaaataaataggaacactgctccttttctccataaaaatgtttggaacagcgtatagtatgcatggacatctggagctaataataggttgcctcaggctaagtctctagatgtgtagaccagggattggcaaactatttctgtaaattgccagatagtaatatttttggctttgcaagtcatagtgtctttgttgcaatttctcaactctgccatggcagccatagacagttcataaaccaatgaacctggctgtgttccagtaaaactttatttacaaaacaggtggcaatattcaggtagtggtagtggtgggaagagtgaacagctcatatttggttttcatttctactaacatggattggtctttagaagaaaattcattttaagtattcactatcaatgaatatttgaaaagcgcctcatttaagtatttggtttttattttcatacatctcaaatcaaattaaagaagtatcttaaacagataagatcttggcttgaaaacaagcatggcctaagggctaaaaccaatgattttattatctttgctgttatacacaagggatttttttcccctcagtttaatcacagatattctgctaaagaagataagcctttgtccagaggctgggcttatgggggcatcgaattatggaattaacctggaaatcaaacatagatttgttttgctgttaaggaaataactgtgtttcaaactgggagaatttctcatacttcactggctctgcctgaaaccataaagtaaaagctaagttagcaaatactcacctgtggcttctcttggaatttaatgaaattaaatctttgaatccacttgatgttccatctggggacatgagaatataagactaatatatagaatttgggaatagtcttccattgtttttagagctagaaagaaacttaagtggtcacctcatccaaatttctcactacctaaaagagatcctgacactcagagcaattcttagtaattttttttccacttattcacttgattttcaagtgaattttcaaggccccaatgattttcacttcccggtattcattcccctgtctagtcccctgccacactgagtaaggcttaccactgtaactaataggatgctatggaaattctagattatgacttctgaggctgggtcataaaaaacattgtggcttttgttttttggataatgttcactctgggggaagccaaccaccacactgtgagggcattcagggagctcacacagagatccacatgtgaaggaactggggccccctgctcattaggagtaccatgtgagtgcgccatcttggaagtagatccccagtgcagccaagctttcagatgaccgtggcccaggctgacatcttggctgcaacctcacgagacactgatacagaaccacccaaataagctgtttccaaactcctgacccagagaaatggggagatagcaactatgtctggggatgatttgttacacagcaagaggtaactaatatagctattagagcatgcccaggtactaactgagtttggtaggagggtatataactttgtgtggtttagtggttaagggtgtgagctctgaagtatgacagtttgattttgaatcctggcttggccactaataacttgcaaccttgggcaagttacttaacatctttaagcctcagtttaattatctgtaaaatggagctaatagtagtaaccatcctatagggtttttgtgaagattaaatgatactatatatttaatatctaatgttatctagtacattttataatctaatattagatacataatattaatatgtaatattaaatattaattatatctaatattaatatacatttatagttatatattataaattatacatataatatattatataatatttatataatatatatcaatatgtaatatataagtatatattaaattatatatacttatatatatgttaatattgtatatataatatcatttaatcttaaccctataggatggttactactattatatatatatataaaatgcttggtatagagtgtggttcatagtaggcacccaataaacattagctattagtccttgcttttgaggagctgggagagagagacttgttaccaggtcatttagaagacatcatggtgagtgtgcaacagaagggtgtgcagtgcattctgggagccacagtggaggggcaattaagcctgggggagtcaagattggattccctatgaaactgatgtttgagtggactttggaaagaaaaagaaatttctctgggcacagaagtgagattagggcatttaggaagaagcactgttgtttggtgcaaaggcgcagatatggcagaacatagcacaggaacagactgtgagatggccacaaatgctggggcacagcttgcactggtggaagagacagcaaagggagtgatgggagatgataagtggaaggaaggctttgtgggtcatgtcaaagaacaggccagagggagctagtatagtttttttgcggggaggcaaataacttaagttttacttctgtattggtctgttttcacactgctagtaaagacgtacccaagactgggtaatttataaaggaaagaggtttaatggactcacagttccacatggctgggaggcctcacaattatggcggacggcgaaggagcagcaaaggcatgtcttacatggtggcaggcaagagagtgtatgcaggggaactcccatttataaaaccatcagatctcatgagacttattcactatcatgagaacagcatgggaacaacctgcccctatgatttaattacctcccactgggtccctcctacaacatgtgggaattatgggagctacaattcaagatgagctttgggtgggaacacagcctaaccatatcaacttccttaatcctagtattaaagatcatggtctggagagggacagattgcagccactaagaccagttaggagttttgcaaatggctcaagagaaggacggggagggcctaaacttaggcaatgacaggggtgaggaggagtaggaagtttataaatcatatcccaggagataattgtcaaataactgcataatgataatacagatagcacagtgatcctcccttatccatggttttgcttttcattgtttcagttacctatgggcaaccaagttctgaaaatattcagtggaaaatgccagaagtaaacagttcctaagttttaagtcgtgtgccattctgagtagcatgatgaaatctcttgctgtccagctctgtgccacctgggacgtgaatcatctctttgtccagtgtatccatgttgtatatgctacttgcctgttagtcacttagtagctgtctcagttaccagatcaactgtcacagtgcttgtgcccaagtaacccttatgttacttaataatggccccaaagcataagagtagtgatgctggcaattcaggtatgccaaagagaagcttcctttcagtgctaaggtgaaagttctccacttaaggaaatttaaaaagaaatcatatactgaggttgctaagatctacagtaagaacgaatcttctatacatgaagttgtggaggaaaaagaaatttgtgcattgtgtgcgtgtgtgtattagtttggtactatctgaggtttcaggtgtccaccaggggtcttggaacatatctcccaaggacaagagcggggactactgtacttttctaacttttccactagggctttacaggacttccatcaaatggagattataactgttctgtgcagctaggctttgctgaggaaccattaatatgccaaccattatgccaggtactttaatgtatgttatctctaatcttcacaacagttctataaacttggtattatgggctcattttacagaagaagaaactgaagctcagagaggtgatgcaacttgcaaaagactgcaaaactagcaaattgcagagctgggagtataacccagcttatctgattgcatcctgtttatcgtcacactacactgttcaaaactggataggaaatgtgagaattacagtcacgtgataggctgggtgcagtggctcacgcctgtaatcccagcactttgggaggctgaggtgggtggatcacttgaggccaggagtttaagaccagcctggccaacgtggtgaaaccctgtctctactgaaactacaaaaattagctgagcatggtggctggtgcctgtaatcccagctactcgggaggctgaggcacgagaatcacttgaacccgggaggcggaggttgcagtgagctgagatcgtgccactgtactccagtctgggtgacagagtgagactctgtctcaaaaataaaaataaaaaataaaataaaaaatagccatgagatgatatacaggaacacactctgaaaaggttaagggtatgatataaatgtgttagagtaatcattattatatcaccccctcacccatgctgctcgttcactggttgggggattgtttctcttctggtatggaaacaagatattatagaatgtaaggcagccaggaggtgagagtgagaagtttagatggtccccaagtcctactgatttcatgtccaaaagggttgtggcatcaagcagttcattattgcctcttctaacgatgctgttctctgcaagctttttggccaagcctgtgatctccttgggtctttagcttatgggaagagtggaggaggggttattctgtaagctagcttaaaaggagtatttagatatactcccccaaaaggctttactttccaaagtttacactgagattttaaaagttttgttaagtgagctgaagttaagtcatgaacaaactttgaatagtttgtgaaattgacagatgatgcacttagcaagtctgtggaacacctgctacaacttttttgtttttgttgttgtgacagagtctcactctgtcacccaggctggagtgcagtggcccgatcttggcttactgcaaccttcacctcctgggttcaagcgattcccctgcctcagcctcctgagcagctgggactacaggcgctcaccaccacgcctggctatttttttaaaatatatatttttattagagacaggagtttgccatgttggccaggctggtctcgaactcttgacctcaagtgatccacctgcctcggcctcccaaagttctgcgattacaggtgtgagccaccatgcccagacctgctacaccgattttaaggcattcttgtcctggtctagttgaggaatttggaggtcctgatacagacccccagtttctgaagcctaaccaaggaggcacctgagaatggtgttctgggtagtatcctgggaggacaaaactagcttcatctggaatgctctgcagtctcatgggattcctgttaccatggtaagtcccagaaccaatgcctgtaaggatgcaatttgccgcttgcagggtatttctaaatgctgttttcagacatagtgcactggtcaggttggctgcagggctggtagtaggaaagcatgaaatgattatcagagtcaacctgattaaagacaggatgtaagcaagccagggtgaggtgagcatagggacctaaaaaccagccatgggaacaggagacaggatgtcagggagaaatctcattaattgaccttgatggtcacagtctcatttgtcttctctttaaaaaatcaattgttttttacccttatttacaaaaggagttcatatttattgtagaaaatctagaaaaattttaagtgaactaaaaatttaaaaagttaatatcatttaaagatagtcatggttaatacctttgttgaataccactgagatgtatgtttatctacaaatattttacagtttaaattaactagactcatccaacagtactactttttccccactgaacattgtaacatgaatattttttccatttattacatattcttccaagtcatcgagtgtagtgttcaattgagaaaacaccttaatttatttaattacttcccaatggacatttaggctgtttccctattgttaaagaaccctctgtattaataagttttgtggctttctgtctaaatctgagaccatttctttagagtaaattcctagaagtggaggagttgctgtatcaaatggtatgccccatttgagggttttgaaatgcatcttacccaacttctctcaagaaagcagtacaaatttgtatttccagtaacaacaaatgagatggtttaacctttaatgagttgcatcttaaagatactgttggaggaaatgaatagagagactcagttttttgtctaactgatatagggaaaatatcagtcacatttcattcttgagaccattattgcataaccagatatggttcagtgaacccacataagcatttgttgagtacctaccatgctcccaggcctgggctgaatatccctgctgctagtgtcagtttcaaatacttagtacagcaatcaataaatgagaggacctgttggaatatgagtagaatatgagacaccgagctttatagtggaaggaaattagtgttttctttgccagatgttaaactatagcagtggttctcaaagtgcggtccctggatcatcagcatcgcttgtgatagatggggattatctggccctacctcctgaatcagagactctgggatttgggcccagcaatttatgttttaacaaggtcttaaccaccaaacttctgcaagatgccaaagattgaggaccgctgagctataaaaaggcagcaaatgcagaagaggtcagacttgttgggtaaaggtggggtgactaacttctcctggtttgcctgggaccatcccagttttagcacagaaagtctcgcatcccaggagccccttctgtcccagctagacagggatggttggtcaccctggtaaagggtggcaggggtgaagggaggttctctttgttgcagcctaaaggtaattatggcagaaaaagaatagaagggccagcagagaaggtttcaagatggagggcagatttcagaagctgctttctgcttgtcagctctaggctgatagatgtggtggcaggaggttacctgcaggaagccagcagatggctaaggcatcttgctgaatcccttgacaggagtcacagctgttagaacttgatactttctggaaaggggaaggttggcattcaccaaactactgcaagatgccaacttgaaaaaaaagccatgattaatcttagcagtgatgacaatgaaatcattttacagcaaaaaccataaccaaaagtgctttgtaattgcagcaatttccatgtcctgactgatggccccctagattctagaatggtgtcgggcttatctgattacaagaactaatcctgaataagatgtaacattcattcttagagtaagcattcatcccggattttctaaagcaggtgcaatttaaactctttttgttctttactacagtcaataatgtataaggcatgtaaagtttcagttttgaaagtatagtgtgcaaaattttaataaaagtaatcatacgttacattgttacatgcatggtgttgatgacagaaagacaggagggctgatttatagatcagttaaacataagaaattccttatttttcctaaaccaacaattctgaacctgttttcatagtcgaatcacctggggagcttttaaaaaatgcttatgttcagggttccatcccagagatggtgacttaataggtttgaggcaggggcttggacatagatattaaacaagcaaaattccccaggtgatgtgcatttggggttgagaatactgtacttaccctgatataaaccaatgggtcccaactttagcatgtaccagaatagcctgaagtgctattcagtaggtctagggaggtgggggtgcaaacatttgcacctctaaggagtgccctggtgatgctgatgctgctggtttgcagaccaagatttgatcaccagtttcctaaaccattcctactccaaaccccagataatcgtacaaaccacatctgtcacccattagctagacatgtgaataaataactccctctcaaaacacttctgcacatctactcccacgtatccagtatttcttttctctactgagtttaaaacatatttcaattaaaaagcatactttagaaagcttggtataggtttaccttcctctttaggtcttgcaaaataggattatttgtcgagtggtatcctttctccctcactagattgtaggttctctgaggacatttgtttgttcgaaggttgcccatgtggcttaggacatcataggtgctcagtaaatgttagtagtcagtggttatgcatagaaattgcatcatcataaccaaacccacctattcccagtagtttttataatgggatctaaatagactgacactccaaaattaggatcataaaacgtattcacttagagaagtcgaagctattgcacaggacaagtaaaataatcaaagaagttagcagaaggtaactacaagggaatttcaccaagaaggacaataatgtagataagatgatatatcagcaatagccctgaaatgtggactgatacatagagtagtttagtaatataagcacacacttaaggcttttgaaaaaaaaataactgtcacaacttgtactggagccacattaatacatcaaaaaatccatgcaaatgaccaaatatcccattgtttgacaaaactaataatgcaacagaatgtattgacatagtccaccccttaacaaaactatcacaaacatccacactgaaagaaaacagacacaggtacacacttaatgaaaaaacccaagtatatttctggagaaagcagctacagcaaatatggaaacagatttagttcaataaacagctgaatgtgtatgctggtccacacatcctcaagcccattgaattttcctttggaattttcccttggtcacctttttttggattgaatttactttgtcatttgcccctggctctgtcacttctgtccagaggctgctgcagggatcctaaatgaacaaattcaatgatgcttattccttcagaggagtcaaaagagatgttgaatttaagaatgaaatgctcctgaaggtagatgagttcaagttgtcttgcattgtgttactacacttacaaaagtttgctatagagaaaggagaaaagcacatggtctgggtttctgaagactggcagtgaaagttggaggcttcctattttgtaaaatctgaccaaacatggaaataacaggaaaagatgtctgagtctggttcatagttgtctaaaatcatcagcatttataagttattaacacatcaatattaaaaattaatattaaattattaatttattaatactttattaatattaaattattattattaatatttaaaaaacttccaaataacatacaattttggaaggtaatgttttaaaaatattttctgtatgataacttttctgaaccatacacttatgaatatggaacttaaaattaatgctgcagtaaagtgaacgcaacaatgaatgtagggaaaatggattaaattagttcaatattctgcaggccgaaggcctttgatcaatattttgtctaattttctctttccagcatatatcacaaacataaaaaggaagaatattccacttttattgggggtcagcagggagggctaagaggatacaggagtgatggtatttgcataaaactggctggactatttagcttgttaatatctgtattgtgattgaaagtttattggaaaaatgtgctgatctcaaaactacactagttcggcaatgatagcaagagaatggaaccaacaaattctttcatctagaaggaaaatgaaaaccagaacttgaataatgggatgtatcttagatctggtactgaatgtggaaaattcaagaagtaatacattggtactactaatagtatcatgtaaggttttaaactttgtctaacaagatgtactcataatgataggtaatgcttcaaccccagtcatccctctgagtttcacaagatacagaatcagttaattcaacaagtatttattgagtgcttaccatgaaccaggtattgttctagctctgaagacatcaccattaaagaatagtaaaaaataaaaatcccttttgtcatggaacttgcattctagttggggaaagacagaaaacgcatacaaaataagtcaaatgtaaactgtcttagatggtggtaagtgttacgatgagttacaaagcaagaaagtgggtagaataacatcctgccccttaaaaaagcactagggaaggggttaatgaaaagatgatcttagcctacatacctgaagcgagccatacagatagtggcggaaagtaggttctaggttaggagaagagaggcgtagggcaaaaggaaaattattccctttttgcatgtccttctatacagtgtgaatttgctaggcctgaatatatttatttatttgttttcttgaggtctgagctgtggaataatgtgctaaatttgttttcttctctatacttgtttgtactaaaaaaaactctaattaatgcagcttacaataatgtgtactgaaacccagacacattgaggcatttaacttttctgggaaagctgtagctaccgtcagggtatgatttatgactataaaagtcaaatagttgagcctggggtaatcacccactgaatgtgattggttctttggcaattgtgtcctaaacaaaagcactctgtcttttatggtcagcattttgctaagctccaactaggttactccatatttactgataggagaattgtaatgagaaacaccagtaaaaaggagaggttgaccccagtagaaaaccaaaagcaggttcttgtggctttcccaggtgcagatttgaaaaagacagtattactgataaataattaggttattacaaagaccaatattttcttttgtcagaattttaatcattgaagtggtataaccacaatttgtatttttgcctgaaataggagtggaatttgctggtgttaacaaatgcaagaacaaaataatactatataagcttagttaactgtttttcaatagcctttagaagaattttctgtaatacacacacacttctttttttttgagatgctaaaagaaattttaataattgttacataacatactgtgtagctatttgatgaaatctacctctgtgtaataattattaaagtaagtcttgaaatgtatgataagaatatattagttttttgggtacaatttccatgaaaaaaataagaaaacaaataaataactaaaataagaaataggaggttttttatacatactgttgtcatcatacaaaattactctattaactaaatttacctgacattgtcaccgttaaaagcaaaatcaagacaaaactaattctcaaatttatttaattttagtaatatattttatttaaccctatatacccaaaatattttcattctaatatgtaatcaatatacaaaaattattaaagagatgttttatgttcttttttcatactaaggcttgaaaatccagggggtattttatttatttttatttagtgtactttaagttctagggtacatgtgcacaatgtgcaggtttgttacataggtatacatgtgccgtgttggtttgctgcacccatcaactcgtcatttacatttggtatttctcctaatgctatccctcccctagccccccaccccccgacaggcccctgtgtacacacacacttatttctaaaagaattaattttaattacacaagtttattatctttggataatcaaaaggtaaaacattacgtttatgtgtagagccctttttacgagccaccaccccaaatcctgattttcttcaaaaggtaaccactgtgatcactttgataggtattttacagacttttaaggaatttacatatgtatacacatatacacacaatacatgtatatgctcacactggtaggatagttatgtaagaagataaatggtatttatatgtctatatctgtaccttgctttatgccaacaacatgtcttggggattatttcccatgctggaattttaagacctacctctttcttttcacttactgcatagcagtccacaatatggttataccataattaattggcctcttatttggacatttagcttgttgcacacttctcaactacaagccatgcagcaatgaattctgtagtgcacttgtgcaagtgatcaggcagtggttctcacggtggcacccagaccagccgcatctgcatcgcctgagaacttgctagatgcaaattcttagccctaccctagacttattgactcataaactgaggatggggcccagcaatctgtagtttaacaagccctctggtgaatctgatgcattatacaatttgaaaaccactggcaggtatgtctgtttctacagacacacatgtacggatacagtcagttctataatgtaacatatgtgttcttaaacaccactgtgctatgcaaaagtatgtaataaaaggcctcggggcttttgagaaaaatgaggttggggcacaacagttaaaaacttcatcagtgacacgttaaaaacaaaagctgggagaccaataaaaatgatagtgcggttttatacatgttaaatgggtaaatacacaaacgctacagtaaatatggcaccttcccttgaaaagaccagaagtttgcttgtgtaagttggtattggaggggttgacccttgtgagtttttgggtagtggcggaaggagggttacatgaaattggaaggtaagttttaacagcagatgtggtgagtgtggctcctgccgcacgtggtgaactgaggcagttggtcatgttgaggtgtgtgtgtgtgtgcattttgggtattcctatatggctcagtccatttgggtgcatttttctgcttttccctagcatttcttgtggataagcaaatgcgaaattggagttatgtccaaattttcccccagtgtatcaatttccttggaataaatttgccttttcgatacaggtgtcacagctgtatgtatggatgcttattcttttgcgtacattacacaaaataactccatacactgtactgaatgctgtttttcacttaatatttcttagagctttttccatatcgccacatagttactcgtttttttttttaatggcatttaaagcattaagagatgactaaattgatctccaaaatgcttgcaacaacctacactcccatcaacatgcttcctacaccttggccaatattacctattatcacatttattaacttttgccaaccactagttaaacgtctctctccttcctctccctccctctcctccctctcctccctctccctctcttccctctgctccctctgctccctctgctccctctgctccctctcctccctctcctccctctcctccctctcctccctctctctctccctctccctctccctctcctccctctgtctcctcccccacctccacagagacatttacactgtgaggaatgcctcccgtaagtacactgatagaaaaaggaactttaaaagtgtgaaacaggtggcgaggtggtgttgaaatggtaaaaaaaaaaaaaaataaataaataaaaataaaaaggaaataaaatggatatgaaagaatacataaaaacctattaaaaaggcagaaaaaaggaattccctttctgcttatttttcacttctacctttgctaaatacaacttatccactttatgagataagatattgagttgaccctgtaggattccatctatcactctagctggttgacatctccaaaaatgcagcttacactattaatccattcacttcagcaaaacatgcctaagggcatcagattcttctgtttatcagtattgggttccttggccccaacaagctcagcagatacagctgaacagagtgatgtgtggtggcttcaactcttgagtctggggcttctaacggcaaaagtgacagacatagaggctcatgcaggtgtcagatgttttcctgtaaagaggttggcaatggacgtaaatgcttccagctgggcacattaccaggcaggataagccataatgatttaataatgaaatcacattggtttatgatcattgttcttattaggaaatatcattgctttttgatgatttattatgtgaaactgagttttcatataaacactgtgatttgcatttatttgtaatatatatttgcatatgtatatatatctgagtgagaatgacttactaaaagtaatcaccaaaaaaagaggatggaatattgatgtaaatatgccacaaatatttaaggaaatgtagaaattatgaagattattatgatgttgccacttcaaaataatattagatgcattttcctttatgtgaaactgacagagaactagtagctggatccatctctgttttgcaattaggcttttgcacctaatcacaaactacgatattattaataaaatataaagaatatatataagggttatatagaaccaccatttcccttctaaattaaggacttgctttcctgtcctcatttctcctcatgtgttctgacatggaggagagagagaaaaaaaaaagttaagaagagggaggaagaacattttgacttatgaaagagctttcagtctcatggggcctggaacagttgctctggagcagtgaaggacactacagaaggcttctctctctctttttggttatgattctttgctctatcagctgtgatgacttgtaagtacagttcctaggatcaacccagggtgcaaaatttagtggtgagttgcaagggcaaagcaaagcatgtctcccactcatctgcactcaatgtcaggtacataatttgggaagcccagtgcaaaataaaaatgtggggtctcttgttccaaaagcaggaaaaaatgccattgagggggctaaaatataaagccttgccctatctttcatgggctttctctttcaacttgtcatggtattgttttatttgctattcagtgctactataagaaaaattaaagacgtaagtcattagcctgagtgttacttttcatctcaatattgtgcaatgtcagttttaaatgcaaacataagagcatttaacttggatgtggaatcaccaaaattacatagtttgtattttgtagcttgtatgtgcgtatgtattttgttcttaccagcatggaggaaatgctgaacaaaactcaactgtttttattttacttcttaatacatgtacattctaccaatactctctacctttggtttactgatgaataaagaaggactaaaaggaaaagaatctataggttattgtataagtctgttctcacactgctaataaagacatacctgagactgggtaatttataaaggtaagaggtttaatggacttacagttccacatggctgaggaggcctcacaattatcgtggaagataaaagaggagcaaagtcatgttttacatggcggcaggcaagagagcttgtacaggggaactcccctttataaaaccattggatctcatgagacttattcactaccatgagaacagtatgggggaaaccgcgcccatgattcaattatctccacctggccccacccttgacacatggggactattacaattcaaggtgagatttgagtggggacacagccaaaccatataattcaccctttctctgtccttttctgtcatcgttttcagtgtaggtgtttggccaatacagggaagtaacaggtataagaaaggttatgacaggattccttggtcattcatgtttcttagaatgccactaccttcttttggtggttgaagcaaattctggtttgaatggaaagtatggcctcttagggctatcagagcttactcagttctagatgtatcgtatttaccttgtatttgtttggcatctcgctgaactcccatgcactatgggcctgatggagtcctgtgctcctggggcattgtgaatgctgtgtgtaaatggggctcctaggaacaacagacacatattgtgcacattttctctgctcacacacacatgttccattgtcccctcatgctccactcaaaaaatacaagttcaaagataaaaatcattaagaatttcaagatagtggcaggagaagattaaactaagtgcaggacccttctctctgtggggcctgtgtgactacacaggttgcacacccacgaagccggccctttctatatcaggcaaagctgctggacagcctgaagcctcatgagcatgccatgtatgaaggagcccagcttacagcaggctggatattgccaatagtgtaccagtgcaaaatggtttccctgaaacctttaatacacttacttatttcaaactcagttgaattgatatcattgagacagctagatctcttagagggctcccagtgccaggaggagtgcctttcagatgggtctttgaaacctcagtgttatagctagaaccaggtactcatcattgaatcaatctctctatatctcttaacattttttccttctcataggatttccagcaggagagctccagaagcctttcttttggggaacagaatatcctcggtgagtaaatgagtacagaaaccagttactgaccaattaggaagaacatgttgctttggtagaggacagaagaaacaaagtcaaaggttattcagcagaaagaagccatggaatctggcgtgggtcgcctgtactcttatcattttaggtatttgttttctgatccttgttaccagggtgtatggctggacaggaaagccatcttacacataggtggctttcatttttatgcatttattctcttacccattaactcatactaccagtatttggacattgaaggattgttgggatttgaattgatgggatgagtctaaaaccattccaggtagaagaaacagtgtgagataaggagggaaaagtgcttctataatggcagagtgtagtttggctagcccaaatggtatatgaaaggaagtagtggaaaagaagattgaggtttgatattggagggctctgcatggcaaataaggagcttggatactaataggcaatagaaaatattgaactttttgagcaagttagtaagataatcgaatttatctttagaaatataacctgtgtagctacagaataagtcaaaattggtagtgtatggacttagggataccagtttaaaggtcattttaataccaacagattgtagactcatgtaattcagaatttccatacatagtagagattctgataatatttgatgtcaataatatcaccatttctattatatactttttacttttgtgttttaatgcttggaaaattttagtcttgattctatacattgagtctcttgtgttttggtttggatatatgacaatttaaaaatatgtaggtttaaaagatacagattcccataaatatatcaataagagaaatatgttggcaatgttttcatttggcctttgggctttcccggtagcagaccttgtggtaagtattcaagtgcaattagttctttcgggaggtggtacaaggaaacaccagtaggggagtggagaattgagacagtgagggaaataagccaaatgaattatgtcctgtgagtcttttatggctgccaaaatgaattactacaaacttagtggcttaaaatgacataaacttataagcttatagttctgtaggtcagaagtccaaactggttctcactgggctaaaatcaagttgtcagcagggctactttcctttctggaagctctagagatgaatctgttttcttgccttttctagtttctagagggggcccacattccttggcttatgacctcttcctccatctttaaagttccatagtcacatctccttctgactctcatcttctgtctctcccttctacttataaggacccttgtgattacactggtaccattcagataattcaggataatcttcctgttttaagttcaactgattagcaaccttaattccgtctgcagcccctttactgtgtaacataacatattcacaggttccaaagattagcaatatggacatcttttgtaggccattattccacctaccacatgtgtgttacaaagccagttatcaccatgggcaactggagctcagtcttgctggggaactgtaaaacatgcttcagagtgatcccatctcagggacatgggagctggggtatttatctgtcctccaactcaccttccatcattgattgagggctcctaccaggggtacctggcagtgcccatcctaggccaagagggctctagtggctggagaaagtcttcaggcaactagtttcaggtgctgacatttgaaggctgtcagattggtgtgctcaaaaatagtgagggctacgaggacgtgggcagccatcgataaagcttactacagggaagcaccatcgttagagtaaataaaaattgcaggttcttatttaaccaaatccattaataatatcccaggcctcagctccatagttttctttggtgttcagatgtttggactcaatttgccctgcttttaagtttagaaatatatatatatctaaaaaattaaaggtttaggataaatattctttaagctcccttcaaactaaaaaagtcctataattctttgattctgcttactgttaacaatttaactgagcttctattattgtggttatatagctggagactaggaaatagtctggttggatttctgaagttattgatgaagtaatttgtttattgggtctgtgagcatgttagtgtctatttgtttgtaccttaggctaggtcatagttaatacttgagtgtgaaagagagtttttttttcctaaagacttgtttgtcctcatccacttaatgaatagctactacatatcatttgggtactcagcattgggaatatgaagatgctaaagacatgggagtcatggtccagtgagatggcttcccatatgttcatctagtctgtattaataaatggatagcctccagaatcaagggagtgggtatcctttctgctcacagtggtcagcttagtcctcacctgagtgttgagtctaattatggggcatgaacaagctgaattgtttccagaagagagaatcaggactgtaaatggttgaagacaacgtttcccaaagtgtgtgttccatgaaatagtaatagaggtaagacatcctcccctcccttcagttttggggaatcataataattatcaccataaaaatttcctagaagctctccaagaaagaaacctatttagatgtgtttaacacaactaccttttttgtacccattaaccatccccacttctgaccccagccccccaccacccttcccaggctctggtaaccatccttcgaaatgcagaggttcccaaactccccggtgttttgggaaatgctgatctagaattcatgactgaagaataagagttgaaagaacttaataacacttgaagtggaacctcataactgtctgcatatttttgaaggaaagttaaggtggtagaacgacttattatattcaggagattcagcaagtgttcagttagaggctacactagaccaatagatgggagccatagaaaagacatttcagatcagcattatggagagctattacgtttagacccgcccaaagaggaaatgggttaccttagaaggggatgagctcttggtcattggaaatacccaagcagggtattataaccatttgaatgggtttttctagagggggcccattcctctagtaggaagttggagtagatgacctctaagccatttccaactcagaaatttttatgaatttatgattcaggcataggacagcccttacttgataacagtgtgagatcatgattaagctagacagcagtatagttgttttgttgttgacagcaaatccggtgcatatgttaaacccactgagtaattagaacaaaagagaaactgagtaggtagtaaaagtggtgtcttctccattttatttttggaagactagatcttcagtgcaagaaatcttccagtttctggccagccagtcaaggttgcattttaaaagggcgagtttatttttttatgcttatttatttatttatttatttatttatttatttatttatttatgagacagagttttgctcttgttgcccaggctggagtgcaaaggcatgatctcagctcactgcaacctccgcctcccgggttcaagtgattttcctccctcagtctcccaagtagctgggattacaggcatgcgccaccatgcctggctaattttgtattttttaatagacatggggtttctccatgttggtcaggctggtctcgaactcccgaccccaggtaatccacccgcctcggcctcccaaagtgctgggattacaggcgtgagccaccacgcctggccaatgacatgctaatttaaatactcttcattgataaaatagaggacatgaatctaatattatgaaatattattattgtcaggcttagtcatataaaattactttttctttgtctcttgtccaaaggattgtgattaagtaactgagaattgaaacttaaaatgattcaatcattttctgaattctctattgccttttgcaaataggaagcttgttggagcagccctgcttaaaggacatttattgcacagcaatttctataagctcccattgttcatgccttcaattcatccagtcaacagcattgactgagggatgtagaggaccaagtacttattctcagagctgagagacctggaaaaactaaatgttgcaatctgcacactgatagctactgccgcaaaaattaacactatgtaaaattacaaatttgtcccacactgctatgatagctctatgattgaaatgaataatttcactcttacttctttaatgaaggtttgcaatgatggaaaaacagtaggaagcattttttcaaatgcaaattaccttacaggaaagaaataacaaaggaaagcattgccaccaaggggaaaaattaaatcttacaccacttccttgggtgtagttgagacaaacagttagcatggtaaggatcatttatgtcctgtaataacatattactttaaaaatttccattccttccagttatgggtcctatctatttgctgggtgactttgatgttgcatgtcaggaactaactgtgagatatttttagcataattgcaaatctcatgaagaatcttcacaataaggattctaagtggtgtgtaattctcatccacaggttgaatgactaaattaagatacatacagatctgtcacttgcatgagatggtaaagttaactaatcagttaaatcattgttactttcttacgctgtacaaggcatagaggatgtagcaatgaacaagtagataagagagtggcctcaatagaacttacatttgagagagaaaatcccagacatacatatggaaaccccattattgatttcttcatatattcttaatatgctttgctatgtaacaaagcaccaccaagcaaccatttattagctcatgattctgtaatttgggcaggactgagctgagacagctgctctgtatggtgctggccggggtcgctcaactagggctggactcacagacaggtgagtgaaggcgacctcactcacctgtctgtgccccagttgggctggctctcgtggctggggcatggcagggcctctctctcttcctttggagtctctcaacttctggggtttctcgcttcttcatttggcctcattccctctagctgtgtagttgaacttctttgcaagtgacttccaagaaggtggaaaatggaagctactaagtttcttaaggcctagacccagaagtcatacctgaccccttccactgcattctgttggtcatagcaagtcccaaggccagtccaaatttaagaagagggaaatagattgtctcttgatgggaggaggggctatgtgcattcaggggtagggagaattgttggtgtccccttttatagataatctaccacatgcttcttcagaggtgaagagaaataatgtggcacctttttcaaatctttgctattcagttgctatcttgtctacaacagaaagaggaacgtgactacctttgaaaatagagtgatcccttttaatctctactctattcctttttttatgactacatttggaaaacaatttaacttctaagactatagtgacttttcaacaagtttccagataaaatatacatgatatatttactgacaggatcttttcaagccctgttctaggtgttcataaatatatagctatagcagataaaaaaatcatagcaatcttaaggctgaaagggactttagaaatcatctctttcacatccctaatttcagagagtagggcactaaggttcatatgtggtaataatgacaatgtttgttagaatttatattttctttgtctatttcaattggaaggtatgtttagattttttacagctttatgggtatggttattcgattgttattaccatggttactagaaagcagtttatcttggctttccattgaaaaaattaaaggattatgctctgagattcatgcttgtaattgtctccaaattatgtattaatgccatagatctctgagttatggtgctataggagtaattgtcggacatgaatttacacatggatttgataataatggtaagtaccggttcattttataagctgctgcttttataataatgttgactatatggatgttaattgttatgattatctttgcatagcagcagcatcatagcttgaagattatccaaagcaatatgattgctgattgaaaacttttcaccgtgtcttgctgtgatggcttgcaataagtaaacaattgttcccattggtgatcggggtagactttaaaaggcagccttgtaatttcaataaaattagctttgcatttagatcaggattgctgtagctgccacaatagttacagagattgatttatagcttctccctttgtcatttattcattgtcttgagatattctccctggaggagcaagctctgctccaacgatgattatacatgctgccaagttaggactcgttgagttaggactctggagcttggctgactggttcccttttacgatttcgaagattatgcaatgcttaatctatatttttctctatactggcttatattctgattattattattattattatcattattgagacggagtctagctctgtcgccaggctggagtgcagtggcacgatctcggctcactgcaacctcggcctcccgtgttcaagtgattctcctgcctcagcctcccgagtagctgggattacgggcacgtgccactatgcccagctaatttttgtatttttaatagagacggggtttcaccacattagccaggatggtctcgatctcctgacctcgtgatctgcccacctcagcttcccaaagtgctgggattacaggcatgagctaccgcgcctggcctattctgattattttaaagtctatactttcctgataatttatataataggatatgctttgtatcccgatgacatttaagcaaaaagaaaaagcagaatatgacataaactaaagaaatggcttcctttgagagtcctcatcatcattaatcagcactcttttctcctttaactttggagtattatcggaaggccacatgaaatctctgaaacttacggattagtagcaaattactatcacatccatacccacacagtgatttacaggcagtctcaggaaccagctgccctaaggcaacgttatatagaaggggacctctttcttccatccctgtagtatctccaacatccttcctggatgcctaccccagggccagagacacttaggctcttctagaaaagtcttcctgtactcccaccagcccttccttaatcacctagattttttgctcccctggtcttcccttctctgttaaaatgtggctgacttgtagttataaatgtggctgacttgtagttatctgactctgcagagctagactttctgcctttgggtgtttggtttatctgagatgagagtcttagctaagaaaaaaaaaagctaatagtcctttcttcgttctggacctctcttgataggaaatttaagtacagttcctccccagaaccttctggagtctttctcaaaggactgaatctaatggtggcaatttcactctgtaaccaatgcttagaacagtgcattgcacatataagtacatgcccggtacctatttaatgattggttggttagtgggtagaggacagtgactccatactatcccagggggtggtgttagtagtatgtagccttgctgaagagttttggattgttccaattaacaactttacttacgggacttttttgtaagctctctgtataattaaatttaaacgatgcctctgattctcatagtaaccctgaatatagaagacagtctagcagcatccaaattttgtttcaaaggctgtagagaaaatgaagagtgagcacatagcaagaaagcatgtgtaatctttcttcccattgtgttttggagattttcattcttattccaagttttctttttagagcaatcttccctgtctaagcaggacagatgggccttccgtccacactagtggctgtggaatgaatcataacagaggttttatgtgtctttcagctcctggcaacttggaggaaacaggttcctatagggctgagtcagggtctatgatcgcacagtatggatgactcactggggctattcctatggatcatttggaatttcactggtagtaatgctctgattgcctccatgggctttctgaatgaagccattttatttcataatccagtgaacactttgggtcaaatcaggtgaagacacagaatccaagattgaataagactagtatatgtaataaattgatgaatctcatttttaaggtgctctttgttccttagaaggaaagaacttcctcaattgtctttatcctttttgccctttttacaattaacctgtgacattggagagaatgcaggagctgatctcaggaagagtgttccctgctgttatgactgctttttgaaggcttgtcgaggtgagggaaaggaaagatgaatttagtttccataaataacacaaatgtcttcgaacttttccttttgctaggtagaaaatatgataaaaatggaaacctggatccttggtggtctactgaatcagaagaaaagtttaaggaaaaaacaaaatgcatgattaaccagtatagcaactattattggaagaaagctggcttaaatgtgagtacaactgtggctaaggggggcaccttgtggttcatttttcctcatttggacattagcttgctttaaaccattggttctcaaagcgtgtttacaagatcaacagcatctgtcttccttgggaacattcttgagtcctaccccatacctgctgaatcagaatctttggggttggggcctggtcatcccttaaccaggcatgaactttttcctgatatattactagggctggaaaaatacctaaatccttgctatgcctcaaatctattatacttgtagatgaatttaggtaaaaatccatgtgcttcttttaaagggaatgtttataaacactgacttggttctcctggttcttaaaccatgctcagcccaagtgagaccactgctcattcaggcagagaaaccagagtctgtatccttgaatggtgtctagctcttttatcagtgtcctggacagccatttctctgcctatatatttttaaatatctacaactgtgacatgagaagacctaaaatgggtgcttctatgtatctctatatagtgcaggggttttcacactgtgaaaattcatctggagtatatgttgcttcaagaaaagcatagcagaaaggggttctagagtcagacatgggtccaaatctaggttcaactagttttatgaacttgggcaagttacttaatgttcctgagtctcagcatcttcatctgtgaaacgggtcaatgtttctgaactcatggatttgttgtaagaattaagtgagcaaagcaatgtggagcactagcacaaggcctgacataaagcaagtgctcaataaaagatcgttagttaatattcctgatccttcgtgacatactcattagtaccctatcccaggaaaaaacaaagccaaagatttttgggttaaaaaccccccaaaaaacaatagaacagctttcttggaggaagggaatttatatttcctgatgattagtatatacaggcatgaagatgaaacttttcacttaattgaaacaaatgtatccccatactagtcctgagaggtatagattattactaagtgtacaggttttacgtatgaggttcaaaggaattaaactgaggttcaaagagattaaaatccacggtagagtctagattagagtttaagtaagtctgtacgactccaaagtccatactgcttcccctatatcatgctgaggttcttattttaagttcattttatatctgggtgatgtgtgggtggactgctcttcaccattcattttggccaaagtgtcagagattgaaacttaattctgacaaatgtgtacctttgtcacaaggacgatagaaagggcatgcctgtcttagcaccaatccacttaaccatcagaaaacagcttcagtttcattcccacaggagagtgggtggcttcctttgtggatataagggccatgctttattatttttctggcttcatttataggagccgttcctttgtgcctgaatcttgctttgtagtgacttcgggggagctcagatggggcactacagatgcagactgtcagcagctgttgagtctttttttgttgttgttccttttcgtagctgttgagtcttgggagtccaaacctagggccacgtggtctactgaggcagaccagagttcaaggagccagaggggtgaggctgctccaaaaggctctaaattagatataaagcttagagtgaatggctgggcatggtgactcatgcctgtattctaaacactttggaaggccaaggtgggaggatcacttgaacctaggattttgataccagcctgggaaacatacggagaccctgtctctacagaaaattttttaaaaaattagccgggtgtagtggtgcatgcctgtagtcccagctactcaggaggctgaggtggaagaattgttggaaccctatagtgagatatgatcacaccactgcactccagtgtgggtgaaagagagagaccctgtctcaaaacacacaaacacacacgaaaccctcagagtaaaaaggaaggagattaaattttttaagcaggagtggatataatcataatcttcaagagccaagaggagttgggacttgagaaagtagcatattaggaagcaaaggctctggagacagaagactgcttgggttcgaatcccagtgacatgcgagcagtttacttcatcactctgtcttaggttcactagaagcagagcccaagaaggggttccttaggtcattgacttttttgagacagcgtctcgctgagtcacccaggctggagtgcggtggtgtgatctcggctcactacaacctctgcctccctggttcaagtgattctcctgcctcagcctccccagtagctgcgattacaggtgccagccaccacgcctggctgatttttgtatttttaatagatacggggtttcttcatgttggccagtctggtctcaaacccctgacctcaggcaatctgcccgccccagcctcccgaagtgctgggattacaggtgtgagccaccgcacccagcccaggtcagtgatttattcagaaagtcgtttcaggaaaaacctataatggaatgagggaaacctattggtttcaggaaatgtttagcctcaccctgattccacagaggattctggagcacgaactgcaccacagaaattgttcagcccaggtactgggttgttcaaactgcacatcagtcaattactggaaggtgggttataacctcccagcggtctccagatgaggtgactcccataagctaaggttgatctgagctgttagcagttgtgggaatgggtgcacagtttaggcagaaaaggggatctggtgggatatcgacatctgctacactctcggagctttagatcctcatttgttgagcaagggtggtggtaattagcacttacttacctcatacgactgtggataacaaagaatatacgtaaagcaggaatggtagcttttgtgtactgaagctaggagggtcctgagtgattacagtgaataatattttccaaagatttgtttttattcattgatattgcttgatacctgggtgactgggctagcttaaaagtaaagtgttggtaagatccatggcttgaaagttaaaagcaaggtatattagttttctgttgcttgctataacaagttactataaacttagtagcttcaaataacataaattatcatacagcgctgtatgatttattatcatacagctctgtatgtcagaagtctgacatggatctcagtggactaaaatcaaagtgtcagcagggccacattcctttgtagaggttctaggggagtatctgtttcctcgccttttctagcttttagaggctgcccacattccttagctcatggccccttcgtttttcaaagccagcactggccggtggagtcttctcatgttgcatcactctgacactcgctctcctgcctcccttttcctcttgtaagaacttttgtaattacactgggtccacctggacaatccaggataaagtctgcatctcaggatccttaatcacatcataaaagtctcctttgccatgctttatttttccagcttcattttgtggggaccattcctctgtgcctgaatctttctttcttcgcagtgaataaggtaacatattcacagattccagggatcaggacgcagacatctttgggaggccgttatcctgcgtgttatacaagagttgaatgacttttctgtaaagggccagatagtaaagaattgaggctttgtggggcgtatggtctctgttacaatatttaattctgccactgtagcaagagagcaaatacagactatatgcatgggcatggctgtgtcccaataaaacttgatttatgaacaccaaaatttgaatttcatataagtaattttcatgtgccaccacaatattattcttcttttgatttttccccagttgttgaagtatgtaacatccagtcttaccttgaagcctgtacaaaaacaagcagcaggttggatttggcgtgtgggctgtattagtttagaatatttgtgtcctagctcatttaaagttttgagaaacaatcttgaatattgggaataattttttttaccatgctggctggttgtcatacatatcgcagacctcgaccttgtgatctgcactacttctgtttgatttttcttccctaggagaaccactttccttttaattttccatggaaattgctgaaggtaaaatgatgatagttggtcttgaaatcttgttcctgtgtggatggtaaatttttggaaacacaggcacaatgagaagaatactcaaattatgtgagttaatcagagaaagtaacctgtgtattgacattcctgttttttcccattaaaccagagtcactcagaatattgttaacattttattggagctggctagattggttagaatgaagaggtaggtgaaaaagaagtgtgtagcataatgaaatagaaagtattacattccagagcaccttgctgaggatagtttgccatctttcttacaatatattatgcctacctctgatttattgaatgtgattttctctttaaaatatgatacttttcttgctataatattgatgcctcttgctgaatgatagttgaccgtgaaacacgcattcattttttttttttccttttttctttctgttaggtcaaggggaagaggaccctgggagaaaatattgctgataatggaggcctgcgggaagcttttagggtatgcgctgctacatttaccgtggttctaaaaatcaagccataaaacaccatatgggggtacctcaattcataccatagccatgttcttgaggagttagttagttagatattatggaatttctgtaaatagaagtgtgtctccccattgaccctattacataaagagaactatatttcttttttctttttggggtgtgaagtcaccctaaagaataatatttgttattaagaatcatgtatttaaagaatagcttttagaaaatacattcaccatcagatcgaagcatgctacagcaatctccttggggctaggttcatttgttttccttgagtacaggtctttctgtagtcctcctataaatttctcttaaaatatcaaacttctaaattatgaccagagggtagtggttctcatatactgggccaagtgatagttcataataacgttttcatcatccactagtttgtggtcaaataagaagcataaagataatacagaaagatttcataaagctaaatgcattaaatttaatgactagactgttattcctggttatatccttcctatattctagttgaaatatactttattttataaaatgagggcactagaagatgataggttttctcttacgtgtcaaaatgaaaaaaggtaatatgcggaccccaaaatgtattgccataggggccttgccattgtgttagatttgtttgtcccctgctaggaatggaaagaacagctttttttctccaagagttatttaacatctgaatgctttggtccagctgctttggtatacattgagcataaggcctttttgcaggtgtacctgcctcactggtaagcaacaggacatggacttgtgtttcttaagaaaattttgacatgatgcattttgcacgtggcaggagtatatatttgctattcctgtgctagctgagcaaagagaaaaacccaccgttgcagagactcatctcttcttcttctctcaccaggcttacaggaaatggataaatgacagaaggcagggacttgaggagcctcttctaccaggcatcacattcaccaacaaccagctcttcttcctgagttatgctcatgtgagtagactgaggaaggggcatcagggatgagatgcaggacttgagtttgctcccttgatcaaagaaagatttcaaacaaaagtttaatggcatgactttgattttcagcaaaaatgttatcttgattattttcagggtaaatctcatcttcttaatgttctgtagtacataattaattaactgattgaatcaaggtttattagtattttttaaatcaaatgggttagcagccctgtggtaattcatttgatagttcctcaatgtatcttgacttcttaatgtgtttgatactatttatttgtaaccatttctagtaacttgctctttggctttcatgggcctgctctttcctatattgctcctcctttgcctcatttgctgactttatgccaccactctcagcctgtgggggaccctcagggtcatgttcccaactgtctaatgcatatgcagagacccctagagctgaaaaagaacaaaggcaaggagagtcatgtcactcttttgtgagtttaataggctcttggagcagaaattgaaaggaagatgtacacgaaataaagcacagttccgagcctgagtctctgtctaatgaggcaagtgccaaatctttattagctattatactggtttatgtcataaacatacgggcagccttttcaaagaagtcagggataggtcaataaaggttctagtgaatggcctcaccgtgggcaaatgtgtatgaatatgctcaaagctagacaaaaattttcatcagtacaaccttttgttcctaagtctgtctttgctttcactgctaagtaagctcattctcacacgagtcttctataattcactctggtcacaggattcttgcttgcctgcggtcttttatttcttaaagctaataaaaaacactaaataaattattatttagcaacctaatgtcaacaaaactcaactctagtcatccacaacatgactttccttttacttttcctgtttctatcatcacatcccatctttagattttcctggttagaaagcctggattcttaggtcttatttgatgcatctgtcctcaattttacaacatgtattccagaagccagatgtttcatactttactttactttaaaaaaaaattatactttaagttctggggtacacgtgcagaacgtgcagttttgttacataggtatacatgtgccatggtagtttgctgcacccatcaacccgtcacctacattaggtatttttcctaatgctatagctcttctagcccccaaccaaccctctgacaggccctggtgtgtgatgttcccctctctgtgtctatgtgttttcattgttcgactcccactcatgagtgagaacatgcggggtttggttttctgttcttgtgatagtttgctgagaatgacggtttccagattcatccatgtccctgcaaagaacatgagctcatccttttttatggctacacagtatgccatggtgtatatgtgccacattttctttatccagtctagtctatcactgatggacatttgggttggtgccaagtctttgccattgtgaatagtgccacaataaacataagtgtgcatggcatctttctttatagtagcatggtttataatcctttgggtatatacccagtaatgggatggctgggtcaaatggcatttctggttctagatccttgaggaatcgccacactgtcttccacaatggttgaactaatttacactcccaccaacagtgtaaaagtgctcctatttctctacatcctctacagcatctgttgtttcctgactttttaatgatcaccattctaacaggcatgagatggtatctcatagtggttttgatttgcatttctctaatgaccagtgatgataatgagcatttttcatatgtttgttggctgcataaatgtcttcttttgagaaatgtctgttcgtagcctttgcccactttttgatgaggttgtttttttcttgtaaatttgtataagttctttgtagattctcgatactagccctttgtcaaatggatagattgcaaaaattttctcccattctttaggatgcctcttcactctggtggtagtttctttggctgtgcagaagctctttagtttaattagattccatttgtcaattttggcttttgttgccattgcttttggtgttttggacatgaagtctttgcccatgcctatgttctgaatggtattgcccaggttttcttctaggatttttatggctttaggtcttaagtttgtttaagtctttaatctatcttgagttaatttttgtataaggtgtaaggaagggatccagtttgttttctgcatatggctagccagttttcccaacatcatttattaaatagggaatcctttccccattgcttgtttttggcaggtttgtcaaagatcagatggttgtagatgtgtggtgttatttctgagggctctgttctgttccattggtctatatatctgttttggtaccagcaccatgctgttttggatactgcagtcttgtagtaaagtttaaagtcaggtagtgtgatgcctccagctttgttctttttgcttaggattgttttggctatatgggctctttttttttttttttttttttttttttttttttggttccatatgaagtttaaagtagttttttccattctgtgaagaaagaaagtcaatggtagcttgatggggatagcaatgaatctctctctaaattactttgggcagtatggccattttcacgatattgattcttcctatccatgagcatggaatgtttttccattggtttgtgttctctcttatttccttgagcagtggtttgtagttatccttgaagaggtcctttacatcccttgtaagttgtattcctaggtggtttattctcttagtggcaattgtgaatgggagttgactcatgatttggctctctgtttgtctgtgattggtgtataggaatgcttgtgatttttgcccatcgattttgtatcctgagactttgccgaagctgcttatcagcttaaggagattttgggctgagacgatggggttttcttaatatacaatcatgtcatctgcaaacagagacagtttgacttcctcttttcctatttcaataccctttatttctttctcttgcctgactgccctggccagaacttccaatactatgttgaataggagtggtgagagagggcatccttgtctggtgctggtttccaaagggaatgcttccagtttttgcccattcagtatgatattagctgtgggtttgtcataaatagctcttccaattttgagatacgtgccatcaatacctagtttactgagagtttttagcatcaaggggtgttgaattttgtcaaaggccttttctgcatctattgagataatcatgtggtttttgtcattggttctgtttatgtttattgatttgcatatgttaaaacagccttgcatcccatgtatgaagccgacttgatcatgtgatggataagctttttgatgtgctgctggatttggtttgcaagtattttatcgggtattttcgcatagatgttcatcagggatattggcctgaaagttttctttttttttgttgtgtctctgccaggttttggtatcaggatcatgctggcctcataaaatgagttagggaggattccctcttcttctgtggtttggaatagcttcagaaggaatggtaccagctcctctttgtacctctggtagaattcggctgtgaatctgtctggtcctcaactttttttggttggtaggctatcaattgctgcctcaatttcagaacttgttattggtctattcagggattcaacttctacctggtttagtcttgggagggtgtatgcgtccaggaatttatccatttcttctagattttctagtttatttgcatagaggtgtttatagtattctctgatggtagtttgaatttctgtgggattcttggtgatatcccctttatcattttttattgcgactatttgattcttctctcccttattagtctttcttgctagtggtctatctgtgttgttgatcttttcaaaaaaccagctcctggattcattgattttttgaagggttttttgtgtctctatctccttcagttctgctctgatgttagttatttcctgttttctgctagcttttgaatttgtttgctcttgcttctctggttcttttcattgtgatgttagggtgtcaattttagatctttcctgctttctcttgtgtgcatttagtgctataaatttctctctacacactgatttaaatgtgtcccagagattctggtacattgtgtctttgttctcactggtttcaaagaacatctttatttctgccttcattttgttatgtacccagtagtcattcaggagcaggttgttcagtttccatgtagctgtgtggttttgagtgagtttcttaatcctgagttctaatttgattgcactgaggtctgagagactgtttgttatgattttctttctttcttttgcatttgctgagaagtgttttacttccaattatgtgatcaattttacaataagagcgatgaggtgctgagaatatatattctattgatttggggtggagagttctgtagatgcctattaggtccacttggtccagagctgagttcaagttctggatatccttgttaattaattttctgtccatttatctaatattgacagtggggcgtaaagtctcccacgattattgtgtcggagtctaagtctctttgtaggtctctaaggacttgcttgatgaatctgggtgttcctgtatagggtgcatatatatttaggatagttagctcttcttgttgcattgacccctttacgattatgtaatgctcttctttgtctcttttgatctttgttcatttaaagtctgttttatcagagattaggattgccacttctgcttttttttttttttttttttttttttttttgctttccatttgcttggtaaatattcctccatccctttatttattttgagcctatgtgtgtctttctttgcatgtgagatgggtttcctgaatacagcacattgatagttcttgactctatccaatttgccagtctgtgtcttttaattggggcatttagcccatttacatttaaggttaatattgttacgtgtgaatttgatcccgtcattatgctgctacctggatattttacccattagttgatgcagtttcttcatagtgttgatggtctttctttacaatttggtgtttttcagtggctggtgccagttgttcctttctgtgttcagtgcttctttgaggagctcttgtaaggaaggcctggtggtgacaaaatctctcagcctttgcttgtctgtaaaggattttatttctcctttgcttatgaagcttagtttggctggatatgaaattgtgggttgaaaattcttttcttttctttgagattgttgaatattggccctcactctctcctggcttgtagagtttgtgctgagagagatccactgtttgttagcctgatgggcatccctttgtgggtaacccgacctttctctctggctccccttaactttttttcctccatttcaaccttggtgaatctgacgattatgtgtcttggggttgctcttctcgaggagtatcttagtggtgttttctgtatttcctgaatttgactgtgggcctgtcttgctagggaggggaagttctcctggataatatcctgaagagtgttttccaacttggttccattctccccgtcactttcaggtacaccaatcaaacgtagatttggtcttttcacatagtcccatatttcttggaggctttgttcatttcatttcactccttcttctctaatcttgtcttctcgctttatttcactgagttgatcttcaatctctgatatcctttcttccgcttgatcaattcggctattgatacttgtgtatgcttcacaaagttctcatgctgtgttttttagctccatcaggtcatttgtgttctcctctaaactggttattctagctagcaattcatctaacctgttttcaaggttcttagcttccttgcattgggttagaacaatgctcctttagctcggagaagtttgttatcacccaccttctgaagcctacttctgtcaattcgtcaaaatcattctccgtccagttttgttcccttgctggcgaggtgttgtgatcctttggaggagaggaggtattttggtttttgtaacttttagcctctttgtgctggtttctccccatctttgtggatttatctacctttggtctttgatgttggtgaccttcggatggggtattttagtagacgtgctgttcctttctgtttgtttgttagttttccttcttacaaacaggctcctctgctgcaggtctgctggaggtgcactccagactctgtttacctgggtatcaccagcagaggctgcagaacagcaaaaattgctgcctgttcttccctccggaagctttgccccagaggggcacctgccagatgccagccagagctctcctgtatgagatgtttgtcggcccctaccgggaggtgtctcccagtcaggatacacgggggtcaggtacccacttgaggaggcagtctgacccttagcagagctcgaccactgcgctggctgtcaggcagggacgtttaagtctgctgaagctgtgcccacagctgccccttcccccaagtgctctgtcctagggagatgggagttttatctataattccctgactggggctgttgccttttttttttagagatgccctgcccagagaggtgacatctggcagtctggccacagtggccgtgctgagctgtggtgggctcctcccagttcaaacttcctggtggctttgtttacactgtgagggtaaaaccacctactgaagcctcagcattggggaacgccccttccccccccaagctcaagtgtcccaggtcaatctcagactgctgctgtactggcagcgagaatttcaagccagtggatcttagcttgctgggctctgtgggggtaggacccgccaagccagaccacttggctccctggctttagaaccccttctgacgggagtgaacggttctgtcttgctggcgttcccagcaccagtggggtatcaaaaaaaaaaaaaaccacacacacacacacagaaaaacaacaacaatgaaacaacaaaaaactcttgcagctagttgggtgtctgcccaaatggccacccagttttgtgctggaaacccagagccctggtggggtaggcactggagggaatctggaatctcctcctgttctgcaggttgcgaagaccgtggggaaagtgcagtatctggactggagtgcacggttcctcaggctcagtccctcatggcttcccttgggtaggggagaaaattccccgaccccttgcacttcctgggtgaggtgacaccagaccctgcttcggcttgccctctgtggcctgcacccactgtccaaccagtcccaatgagatgaactgggtacctcagttggaaatgcagaaatcacccacttactttctgcattgatttggcattgatttcgctgggagctgcagtccagtgctgttcctatttggccatcttctagttcttctcgatgtttcatacttttaagtgcttttcagatttgacatcttctctcctgttttagacagtttgggctgctataacaaagtgtcatagactaggtggcttatgaacaacagaaatttatcacagttctggaggctggaagtctgcgatcagagtgctagtgggatcgagttttggtgagggctttcttctgggttgcacactgccaatttctctctgtgtcctcacatggtggaaagagctagctagctctctggcctcttcttataagggtactaatcccattcctgagggctccaccctcatgatttaattgcctcccaaaggcccaactcctaatgccatcacattgatcagggcttcaacataagaattttgggggatagaaacatttagtccatagcatccccattaccctatcttatcatatatagttagttatcatatataggcataatcttaataaatatcctctactctggattatcccaacagccttatggaatgttaatctgacttcagcatttttttttttaaccactgttatacataccattggaataccacttttatttcattaccaacctgctgaaagaactacagtggctcccaaatgcctaccacattgaagccaaatacctccatctggcttcccaaattttcagtatgatccaactccactcaatccaattcaatttcccataactaactccactgggtgagaaaaaactcagccttagtggggcaagtatcctcacttctaccctacaatgtcatgcccattactgtctctttggctttgcttctgattctccttctataatgcaacccttcctactcttccccttcagatgattattcaatctaagcttcatccttcaggatccatgttgagttccactccctccacatcttccataaactcttccccaaggaccccagtccttattattttcttttatcttcaactccttttatctttcttactttcattaccatgcagttgagtacttaactgctctccaaatgttcaagaattttagttttatctccacagctaatcttctggatccttacacttcctatctccatagcacccagcaaagatgctgggtatattgaagacagttgatatttttagatcaattgcttgaaatgactaaaactaacagttcaactaaggagactcccttttactgggtcagatatataaaataagtatacaaaaatagaactttctagagttgggattggcaaactagggccaaatatggcctgctgcctgtttttgtaaataatgttttattggaaagcagccacattccttcatttattcatgatctgtagctggttttgtactacagtggcagagttgaataattgaaacagggaccttatagtcttcaaagcctaaaatctttaccatctgtctcttttcagaaaaagtttgctaacccctgctctagaggacaaagtatagtgatctatcaatcagttcttactatttacatcctagcccacaatatctctttgtagataaaataaactaattgattgatagtgaagttacttataattctgaaatgtttccagatataataccaaactaaactatagctgactgatttattgtaaactaaagagatagatagatagatttaggggggaaaagtggaaagctattttatatcttatatcactagtgagaaatttatcttggagcttttcccactgacagaatgaagagatttttcagtcttttgcactttaaagtaagtctgcttataaggagtaaaattactttccctcctgggaaggtactaagaaaacagtagcaggcataatgtgttttcagaagtctcttaagtgatatattaagcaaagacaatactatattagagtataagaatataggaagaaataagaaatgaggtaaaatcaaatgccagaaacaacttcatattagccagcttctgaggaaatcaagggatcgcattacaaaacatcatcttcaaagtcaaattcagaaccactgtgactggtggtttatcttcatcaaaagcaacaacatcatatcacctttcctgctttctatgtccctgtagttgctgtgacctctcatttttctcagatattcttctaatccttctacttctttccattctattttctacttatttagtggacatccattgagaaccttcctggtatctataaataatctaactagcctctaatttcttccttccactatacacccctgccagataaatctttttcaaaatctgggttttattattttcctactcaagaatgacttttaaatatagtttaaacgctctgaccaactgctcaggacttcagaaatctgacactgtccttcctctcccactgctgcccgttaggcatcatatactccagcctagctgaatgtctggttctctttcccctcaaacatgtctttgttcccatttccccctccacttagaatatttttttccatatttatgtgtcctagttcaattcacacttgaagaccatatcatacctcaagtcatatggcaagtcaggattaaagtaagtaagttatgctgcagaaacaacacgacaaagtttatttcttgttcactctccatgtccaacatgagtcagcagtggggctcttgtagtttttcatcaagaagttgggttttgggccgggcatggcctgtaatcccagcactttgggaggccgaggcgggtggattgcctgaggtgaggagttagttagtttgagaccagcctggccaacatggcaaaaccccatctctactaaaaaaatacaaaaattaggcaagatggcttaataggaacagctctggtctgcagctcccagcaggattgacacagaaggcgggtgatttctgcatttccaactgaggtacccggttcatctcactgggactggttggacagtgggtgcagcccacggagggtgagccaaagcagggtgggacgtcacttcacccgggaagcacaaggggttgggggatttcctgttcctagccaagggaagccatgagagactttaccaggaggaacagtgcactccagcccagctactgcgcatttcccacagtcttcgcaactggcagaccaggagattccttacagtaccgggctcggtgcatcccacccccatggagcccagcaagctgagatccactggcttgaaattgtcactgctagcacagcagtctgaagttgacctgggatgcttaagcttggagttgggaggggcatccgccattgctgaggcttgagtaggctgttttaccctcacagtgtaaacaaagccactgggaagtttgaactaggtagagcccacagcagttcagcaaggccactgtgaccagactgcctctctaggcagagcatctctgaaaagcagcagccccagtcagggaattataggtaaaacccccatctccctgggacagagcatctaggggaaggggcagctgtgggcacagcttcagcagacttaaacgtccctgcctgacagccagcacagcggtcgagctctgctaagggtcagactgcctcctcaagtgggtcccggacccccgtgtatcctggctgggagatacctcccagtaagggctgacaaacatctcatacaggagagctctcactagcatctggcaggtgcccctctgtggacaaagcttccagaggaaggaacaggcagcaatctttgctcttctgtgtagacttcactggtgatacctagccaaacagggtctggagaggacctccagcaaactccagcagacctacagcagaggagccctgagttagaaggaaaactgacaaacaaacagaaaggaatagtagcaacatcaacaaaaaggatgtccgatcagagaccatatccgaaggtcaccagcatcaaagaccaaaggtagataaatccacgaggatggggagaaaccagtgcaaaaaggctgaaaactccaaaacccagaacgcctcttctccttcaaaggatcacaactcctcgccagcaagggaacaaaactggacggagaaagaatgattttgatgaattgacagaagtaggcttcagaaggcgggtgacaacagactcctccgaggtaaaggagcatgttctaacccattgcaaggaagctaagaaccttgaaaacaggttagaggaactgctaactagaataaccagtttagaggagaacataaatgacttgatggagctgaaaaacacagcacgagaactttgtgaagcatacacaagtatcaatagccgaactgatcaagcggaagaaaggatatcagagattgaagatcaactcaatgaaataaagtgagaagacaagattagagaaaaaagagttaaaagaaatgaacaaagcctccaagaaatatgggactctgtgaaaagaccaaatctacatttgatgggtgtacctgaaagtgacggggagaatggaaccaagttggaaaacactcttcaggatattatccaggagaacgtccccaacctaacaaggcaggccaacattcaaattcaggaaatacagagaacaccgcaaaaatattcctcgaaaagagcaacccaagacatataatcatcagatttaccaaggttgaaatgaaggaaaaaaggttaaggggagccagagagaaaggtcgggttacccacaaagggatgcccatcagactaacaaaggatatttcggcagaaaccctacaagccagaagagagagggggcaagtattcaacaatttcaaagaaaagaattttcaacccacaatttcatatccagccaaactaagcttcataagcaaaggagaaataaaatcctttacagacaagcaaaggctgagagattttgtcaccaccaggcctgccttacaagagctccgcaaagaagcactgaacacagaaaggaacaactggtaccagccactgaaaaacaccaaattgtaaagaccatcaacactatgaagaaactgcatcaactaatgggcaaaatatccaggtagcagcataatgacaggatcaaattcacacataacaatattgaccttaaatgtaaaggggctaaatgccccaattaaaagacacagactggcaaattggataaagagtcaagacccatcagtgtgctgtattcaggaaacccatctcacttgcagagacacacatagactcaaaataaagggatggaggaagatctaccaagcaaatggaaagcaaaaaacaaaaacaaacaaaaaaaaaacagaggttgcaatcctagtctctgataaaacagactttaatccaacaaagatcaaaagagacaaagaaagaagagcattacataatggtaaaggggtcaatgcagcatgaagagctaactatcctaaatatatatgcacccaatacaggagtacccagattcataaagcaagttctcagagacctacaaagagacttagattcccaaacagtaacagtgggagactttaacaccccactgtcaacactactgccaacactagacagattgagacaaaattaattaacaaggatatccagggcttgaactcagctctggaccaagtggacctaacaggcatctacagaactgtccatcccaaatcaaatcaacagaatatacattcttctcagcaccacatcacacttattccaaaattgaccacatagttggaggtaaaacacttctcagcaaatgcaaaagaatgaaaatcataacaaacagtctctcagaccacagtgcaaacaaattagaactcaggattaagaaactcactcaaaactccccaactacatggaaactgaacaacctgcacctgaatgactattaggtaaataacaaaatgaaggcagaaataaagatgttctttgaaactaacgagaacaaagacacaacgtacctgaatctctgggacacatttaaagcagtgtgtagaaagaaatttataacactaaatgcccacaagagaaagcaggaaagatctaaaattgacaccctaacatcacaattaaaagtactagagaagcaagagcaaacaaattcaaaagccagcagaaaacaagaaataactaagatcagagcagaacggaaggagatagagacatgaaaaacccttcaaaacatcaatggatccaggagctggcttttcaaaaagatcaacaaaatagaccactagccagactaataaagaataaaagagggaagaatgaaatagacgcaataaaaaatgataaaggcgacatcaccaccgatcccacagaaatacagtctaccatcagagaatactataaacacctctatgcaaataaactagaaaatctagaagaaatggataaattcctgggcacatacaccctcccaagactaaaccaggcagaagttgaatccctgaatagaccaataacaagttctgaaattgaggtagcaattaatagcctactaaccaaaaaaaagttgttgaggaccagacaggttcacagccgaattcgaccagaggtacaaagaggagctggcaccattccttctgaaactattccaaacaatagaaagagagggaacccttcctaactcattttatgaggccagcgtgatcctgataccaaaacctggcagagacacaacaaaaaaagagaattttagaccaatatccctgatgaacatcaaggcaaaaatcctcagtaagatattggcaaactgaatccagtggcacatcaaaaagcttatccaccacaaccaagttggcttcatacctgggatgcaaggctggttcaacatatgcaaatcaataaacataatccatcacatacacagaaccaatgacaaaaaccacacgattatttcaatagatgcagaaaaggcatttgacaaaattcaacaccccttgatgctaaaaactctcaataaactaggtatcgatggaacgtatctcaaaataataagagctatttatgacaaacccacagccaatatcatactgattgggcaaaaactggaagcattccctttgaaaaccagcacaagacaaggatgccctctctcaccactcctattcaacatagtgttggaagttctggccagggcaatcaggcaagagaaataaagggtattcaaataggaagaaaggaagtcagattgtctctgtttgcagatgacatgatggattgtatattaagaaaaccccatcgtctcagcccaaaatctccttaagctgataagcaacttcagcaaagtctcaggatacaaaatcaatgtgcaaaaatcccaagcattcctatacaccaataacagacaaacagagagccaaatcatgagtcaactcccattcacaattgccactaagagaataaaatacctaggaatacaacttacaagggatgtgaaggacctcttcaaggagaactacaaaccactgctcaacaaaataaaaagaggacacaaacaaatggaagaacattccatgctcatggataggaagaatcaatatcgtgaaaatggccatactgctcaaggtaatctatagattcaatgccaaccccatcaagctaccaatgactttcttcacagaattggaaaaaacttactttaaacttcatatggaaccaaaaaggagcccatataaccaagacagtcctgggcaagaagaacaaagctggaggcatcacactacctgactttaaactttactgcaaggctgcggtaaccaaaacagcatggtactggtaccaaaacagatatgtagaccagtggaatagaacagagccctcagaaataacaccacacatctaccaccatctgatctttgacaaacctgacaaaaacaagaaatggggaaaagattctgtatttaataaatggtgttgggaaaactggctcgccatatgcagaaaactgaacctggaccccttccttacaccttaaacaaaaaatcaactcaagatggaccaaagacttaaatgtaagacctaggaccataaaaatcctagaagaaaacctgggcaataccattcaggacataggcatgggcaaggactttatgtctaaaacaccaaaatcgatggcaacaaaagccaaaattgacaaatggaatctaattaagctaaagagcttctgcacagcaaaagaaactatcatcagagtgaacaggcaacctagaggatgggagaaactttttgcaatctacccatctgacaaagggctaatatccagaatctacaaaggacttacacaaatttacaagaaaaaaacaaccccatgaaaaagtgagtgaagggtatgaacagacacttcttaaaagaagacatttatgcagccaacaaacatatgaaaaatgctcattttcactggtcattagagaaatgcaaatcaatcaaaaccactatgagataccatctcatgccagtgagaatggcgatcattggaaagccaggaaacaacagatgctggagagaatgtggagaaataggaacgcttttacattgttggtgggagcgtaaactagttcaaccattgtggaagacagtgtggcgattcctcaaggatctagaaccagaaataccatttgacccagcaatcccattactgggtatataccgaaataattttaaatcactctactataaagacaccatgcatacgtatgtttattgcggcactgttcacaatagcaaagactgggaaccaacccaaatgcccatcagtgatggactggataaagaaaatgtggcacatatacaccatggaatactatgcagccataaaaaagaatgagctcatgttctttgcagggacatggatgaagctggaagctatcattctcagcaaactaacacaggaacagaaaaccaaacaccacatgttctcactcataaatgggagttgaacaatgagaacacatggacacagggaggggaacatcacacaccagggcctgtccagggggtcgggggctaagggagggatagcattaggagaaatgcctaatgtagatgacgggttgacgggtccagtaaaccatcatggcacatgtatacctatgtaagaagcttccacgttctgcacatgtaccccagaatttaaagtataataaaaaaaaaaatacaaaaattagctgggcgtggcggtgtgcacctgtaatcccaggtacttgggaggctgaggcaggagaatcgcttgaacccaggaggtggaggttgcagtgagccaagattgcgccattgcactccagcctgggtgacggagcgagactccatgtcaaaccaaacaaacaaacaaaaaacttgggttttagagtctatatcttggcatgtgcttctgtggataccacaggagtagaaaagacatacgaggatatgtgcactggccgttagtgtagcatcttaaattgttcttaaggctcttaaaacttctgtcaggttttaaagcttctgccaggaagtaacatatattacttctgcttctgctcacacttcattggccagaacaagccatatcgccatgcccaacttcaaaggagatggagaagtgtacttcagtcctaggcccagactagggtgaagcgagcaaggcactcaggggcagactactaacttctcatcaccatcctcaataatgggtggctgactcattttattgatttgaatgagtatggttaaatttgagaaggactatttcaaacattaaattcattgaatgaatacactggtcgattcctgggcacatatacgattctcttgatttaaagcacttgtctggaaacctttctcacttactcaaattgtgaaattattcacattgataaaaccttctactctggggatcagaataatagatgttattacagatgacggttttatttgatcttctaaaactgtttgtcatccattggttctaaaattgttcctcagtataatttggagcagttaaaacagcagaaaatacataattggaatgaaagctcatttgttgggatgcttttctcttctaggtgaggtgcaattcctacagaccagaagctgcccgagaacaagtccaaattggtgctcacagtccccctcagtttaggtaaatgggcaaatgggtgacggcagtttttaactgtacatctccccccttcctcccccacccagccatccaagggctctaccagataggtgatctgaaaaaaatcccacattgtggacgtgtgatttccattttgcagccaaaaaatatctggccacacggaaactaaatatcttctttcattagtagtaagctggtttagtcagcactctctcacctgaatttctgctgatggtacctgtacatatctagtctagtgctacatcaagtgccagtgagactatacaagactccagaggtaattcggaatccgaatcatagctttagtattacatcccattatcttctagtttttgaaagagtctcagtaaactgcattattggacttactcaactgcttacttttttgtccaaaaaaatagcctttattgtcttaggaaaggatgagatttgatgtactctgccttaaaacacctagcgctctggtttattttgttttaaagaatatcccctttaatacctcttgttctttcacacagtcaaccagcaaacatgaatgaatggccactttctaaatagctctgaacacaaaggaggatacaaagtattattcagcaattataatttatatctagagttagagagtctacattttggctttcaggtgggatcatattttgaaacggtagcttatacaaaaaaggaaaaggattatgaattgcagtcttatttgtcagaatgtataaaacattaagtacaaataaaattaaaagttaatattactcaccctgtactcggtcgtacaggttgacagaaattttctatagtaccggaaagataagtatgatgagaaacccaaaaaccataataatttatatgtattcattctttgtttagggcattatatctggatatctttatatttaatgtttaaacagatccattagcatattgcaagaaagccatctaaaatttcttctatatgttaaaatcttattcttaagatcttgccttagaaatgcttcagaaattgactataaattacccactagcataaaaatctaatcactatgttggaaatttctcccccactgggctaaactgtcatgaaggctgacggtctcgaacgtactaaaatgtgttcccactgaccaatggtgcagatgaactcacacagtagattaattactcaacagataagttttcagaaacttatttcctttaactagttgcctgtaatgttgaattttacagtgcatgcttactaattatcaactgtattctatctttaacacttgcctagggtgaatcacactatgaaatatgcatccctacccatatattcagctaaaacaacaagaggttatgaggattttttggatacagtccattacatttatgcaaatgcccgtaggtaacaaagtcattagggaagaaatagtcagggactgagaatgctgagtctctagtcaaccctttgaacacggagttgagtaagaaatagaaggggggaagttttttgtgtgtgtgtgtgctggcttgttactgaggtctgcagtaactatagattttgagtgcagcagaaatcacacaatggcaataccacttccaaaaggcagctacaatcaaagtgctgagtaggaatccagtctttgctgtagttggaagcctgtaagaatgtgacatattggagctaactccagtgaagaattatcagtaataactagataccattcattaattgactgattgttgcattaatcaaattctgggcaactgtgagcttcccatacctaacactaattcagagaaaatgttttgcagattgaatgaattctttaaaaatagctggaaatgcaacaacatggatgactcttatagacattatattcagtgaaagaaatcaaagaccaaacagtacataccatggattccattcacatgaagttcaaaatcaggcaaagctatggcaatagaagtcagaatagtaggttatcttgggagatgctgttggtatggaacaggcaggagccttctgggtgctggaatgtcttgatctggcagatagtaatatgggcatatacacacaaaaactggcaagtcctacgtttaatattttgcatactttatgtcagttatactttccataaagtttttaaaaagttagaaaaactaatattggtgatgatacagttttaaaagaattttgaagactgttcgaagagtaataggggcatgtgcttggcattcaggagatgctggatctagtctgttaattttttctggaaatttacttaatcattttgggctttagttgtctccctgtaaacagattaaaagaatgccaaccttctttctagcaatattctgctacagttttatacagaacctgttgatgtgcaagaattatatgacatatgctttgacatatcgtttttcagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagctttgtgggaagcctaaattgatgtatcctttaaaagttcaatctattaaacttgtagcctctcaatgatgaagacatgtgcatgaatacctgggagggcttgctgctctgtggaatgcagtgcacgtttttatggacagtaattacacagcattcctcaactgtaaggtagttaaattagaaatatgtttgatctccattttacactttttgatgaagttcttgccttcagctttggagtctgttggaatgaaactgtgtctcacagcttgcatctgatgtagcagattgccctgttcaagtcagcatgaacaaagctcgcagaaaggctactaggtaacggatttgagtttattcagtagaaaaaaagggaatgaggacatatctttaggtcccagaagcagcaaaacctcctagttacataacagcagggaaactaggagatgaaatctccaaaattttgtccagtctgtatgaactgcagtgattgtctgtctgctagacacttttttttagcctaattcttgttcgtttcattaccttcatatgtgtgcattgtactggttttgaaatgagcagacattgagaaaacaattttctgattccccattaggaacatatgattttcatttccctttagtgcaaaggaacaaacatcacattgaggagggagaagtgtacccttctttttcagcttaatgttacctctctttaaaaaaaaaacatttttgaaaaatttcttgactgatgacattctagaatttattgattcaatttaaaattccctgcatagtccaaataaacataatttttactcttcaagtcatctaaagagttgtgagaaagagcagtactatgtgttttatccttagagcattatccttctaagtgaactcctttcttattactgagcgtgtgtgtgtgtgtgtgtgtgtgtgtgtgtgtaggataaaattgtaatggccttaaagttgttacctggcatttttggtttcttaaaataggcatccccctactccctttacattattcattagacatgaggtgctgggttaagtgggccaataggaaaatctcaaaagcaaaatgacaaattcagattaaccacaggaagccattgtgtgtccctgtgatttgtgattcttttaaaaaaaaaaaaaatatatatatatatatatatatatatatatatgtatatctacctaagtgtgtgccatgtccttttgtagccatgggaacgtttgaatggagaaaaatggaggggcaccatcatgaggaaacaattatactgcattagtcagaggagagcgattttccctttgacttcttcctctctgaatggataaacttgtgaagggcagctaccttgtcctcctcttaacctggcttaatgtgaccttagtttgtatttccaaaaacaagcagtattaggttggaattgtatgtgtcttttctctggaggaagcattctgacttggtttagacatataagatactctgttttattcctggacttgggtgtttaaaatcagctgaggtttatcatgcttatatgaatagtgtttcccttctagatttcctttataaactccaaataaacacattcctgcaggtcagagaaagtgtttgataaaagcatagaattatggctttggaaagacaaactaagtcacttgttggtttagcaaaactggttggtgattagttggggccctcacagtttctagatgagaagcttaccttatcctgattaactttacttgctgtaactgttataccgaaaattgtaggtaggatgtccattactcaaacaaagcagaacaaaacaacaaaccaaaagcagcaataccaaatcatcactactagctagaacaatgagaaggattgaatttccaaatacatgcttatgtttaactcaactcttccaattacattctcattgtcctttctcttggataccgattgctaagataaacagacactgattaagtggtagaaagagaaaggtaaaatgcaactggaagggaaagaaaaaagtagggagaagctggcctatggatgtggctttgaagagaagacaggattttggcattccttgctaagcacgttcaatggaggagagccatgaagttttacaaaaataattatggtaaattaaaaggatattagatattggatctcagactagggctgctataatacagttctctgattcgcacaccagatgttctgccagcgaactgttgtctgggcattggaaggagttaggttttttgtgtttgtgaaaatctcctggattagtaaaaaaattttctagatataaagtggttttatttgggctcatgaccattgcccaaagtgtactgagcttttcactaagtgctcagcattggcctcctgttctcatttattcattttatgagatggacttggacatcactaatgcaaacacaggattcataaattattctgaagtttatttagtgccttgcctcaatggagcttaaagcatagcacataaattttatcttatttagccctggagcatcactaagaagcagctaggaactatggcttgccagacagattatgcttgtgccagagaagtggagaagcctgaaatcccttgtcaagtattccacaggaaggaaaggtagtctttgggctttggtctactgacctgtggattaaactctatcccttagattatcccatttctaaatacatttattcaatcagtatttctataatcacttagcatttgataggcttcttccttgatacatttaacataacgcctcagttgcatattacattatggaagaatatacgattgcttcatataacaacattctcatcaccagtgacagtgtcctactggtttgaagaaagatattcttggattatgtgttttatatctaaatggttattctgagactggttgtattttcttctcctactcgtgaaacgatgtgaacaagcattttaaggacaataaaaagttagctggttgaaggctttctgtgtctttcttttttaaaaatattaaaatctattagatctgttaacatattccgtcctgttttacacaacatttgccaaaaaatagtgtacaataactatacttactagctttcttggcttagaaaagtgagatttgaatgcagtaactttctccatagacaagaaggtatttaagaggttgtcattatattttcttccagaatgtaagtcagcagatacggtttattgcctttgtaataatatttctatagagaaagtgatgcctctgaggaaattatcagcgatgacaggggatagggctgatctcacaaaagtgacaatgaacatcacagttactatcaaatcaaacaatctctgtgttatcatcattctttaacaatccagtcaatttatagttattcattcagcacacagtaactgagcacccattatatttaaatcaccaaactagctatatttaggtggataatatacagtgtctgggcttcagtgaacagtctggtctaacatgggagatggatatataaactgtttcaattaccctactgagtgattatgatatataagtaaatcaggttgtggtttggaacacagagaaagaattcttcaacttttgtctggtggatactattggtgtttcctctgcgcagatcccagcaaattccttttactgggtggccttatctcatcttcggtctgcttttgtttctaattggctgtggctctctaggatggctgccctcatgctactggagcctctttgcccaatgcactttcagagaactggaagtgcctcgtgacccttagacagtgactgagtggtatgggactccgcatgcctgactacctcccggagttcagacaaatccagaggcatacaatagaatttatactgatttctctgtggtgtctttcttttagcattatgctgacagtgcaaattgagtcccctgttgattaaacacctttctggcactgatatgttctaagatctggaaaaggccgggtgcagtggcttacgcctgtaatcccagcactttgggaggccgaggtgggtggatcacgaggtcaggagatcgagaccatcttggctaacacagtgaaaccccgtctctactaaaaatacaaaaaattagccgggcgtggtggcggatgcctgtagtcccagctacttgggaggctgaggcaggagaatggcgtgaacccgggaggcggagcttgcagtgagtcaagatcacgccactgcactccagcctgggcgacagagcgagactccgtctcaaaaaaaaaaaaaaaaaaagatctggaaaagtaatggtttgtaggatcctaggtcagcccttctgtgtagtaggtcatatcatcatcatgtacaggaaatggacatcagatggcacagactgtgggtaataagtagctgagtatggcctgtttgtgcccttcttggagagtttatcctagtttctgagctgatccatgaaatgggaatttttgtgtatagggaagtggcacaaggaaagatgcatataaatgacagtgttacatatgtatctaagtggacctgatcaaaatttgcaagaggctgtttccaattaggtttaagatatttgcatgtgcctcaagttcactcgcttttttttattaagatcacactagctgtagaaacagataatggcttaacccaatttatttcttgttttcattacatacataatggatattaattatcagtgagtttctctcctctaactggtgactcagggacccagcctccttccatattatggttctgccattttcaacacatgatttaatgtatgctcatctataagaagccagtggagggaaaaaggccatggaagatactgagtggaagatttgcaattgtccttgaagttgtctacattacttctgttcatattccattggccaaatctaactgcaggggaggctgggacatgtagtctagctgtgtgcccagaatgaagagcaaatgggtttagttctcagggagcattcccaggcacaccttataaagtgacgtatggggcagtaactttgagttcttctgaatttagaaaattgcttttgagcacggcacaatgaaaactgaaaatgccattggtagcctgcagtttattctgtaggagtctttttaattaacagcttaattggataatttaatccccgttagaattggagatatgcaaatgaaaatgagatactccctatgatctgacaatactgtgctttaataaacacaccaaagtgagcctggaaatgagcaccacaaaagcattaccatgatttgtgatcagtgaaagaaaacctgatctataattttaatcattcctaaatggtttagatacatgtttcatttgaatgtgtattttgttttgttaattggttcaattagaaaggtaactgaacataagaatctgtggcaaagccatgaatttataatatgttctaagcttttaaaatatataccattgagaaagtaactaaaataccctacaaaatactgttgaaagtgcagtattttccagtattttcagataatttatatacaatagtttttacttctccattgattatgagatgaaaaatactacttaccatattcttgttatatgctttctccacttgaatgagaaattgaggctcagagtccaagaaatgaagatgagtgtccatgtacaagccacaaaagtgctgttctaattaattctggccggagactccactttacagagaaagaaaaactgagtaagttaaaatcccagtgtaaaaagctacctaaaatattgagtatcattttccctgccagtttggctgaaatgtctgcaaatgtcctagacaaaaaaagtggtatagtttaccatttggaagtacactgtgttaatttccaaattgatttagaagtcagtggaatcccagtacttggataacagtcagacagccctcccaccccagtgacatttgatgaatgtcaaaaatagcccaaagcatatttattccaaagttgaccagattttcaattggcatttgtatttttttttttttggcctaataataatcgtagtgaaaatggcttctgtttgttgacacccactatgtcctaggcactctgctggggcatgcctgctttatggccagtcctcacaacaatcttgcacatagttgttgctattccaacttcacaggtgagaaacacgtgacttgtcaagatcacattagtaactgcaagagccagaaacagtcagttttgtctaacttcagagcccattctcgaatgttctcctgggatatagaacaatgttaacatgattgtaacctgtgacttactgaagacttcaggttatacttctatagtaatctgttagaaaataatgtaaagataggagtcagtttacaataatttatacttactggtagtttcaagtccttcagaaaggattctagatactgctctttactgataatgcttgttaccatttattatctataacgtgccaaacatgtactaaataccttatttatattatctaatttaattatcacaacaactgggatacatattattatctctacttcacaggtaagaaacctgaagcttggagaggttaatgacttcattcatgatcatttagctagcagctggcagcatggatttgaatccagtttggtctaagtgctttcttaggcaaacattaactatggtaactcttaagtcctggatgtccaggctggggcatcccctcagttcagctggcagacctccctgaaatctacctgtgatcagccccatgattaccctcaccctgtctgttcagtccctgaaaccgaaaagtttgcaggttactttctccagacaacaaaatctttgtggccctgcctatgggtagttgagagactttcaagcagtcaccttggttttgaccctatgatgcattctttttaaaatttttttaagatttgacaacactgtgtgtatttatcatgtacaacacgatgttctgaagtatatgtacacattatggaatggttaaatctcactaattaacaattgcattaccgcatgcagttattttttgtggggaaagcacttaacattcactctctctgcatttttcaagaacataataaatcatcattaactacagtcaccttgctgcacaatagatcttttgaattaattccttccatctaactgtaattatgtatcctttgaacaacctctccctatcttccccacccctcagtctctggcagccaccattctactctctacgtctatgagaacaacttttgagatttcacaggagtgacatcatgcagtatttatctttttgttgtctggcttatttcacttaacataatgtgctccaggttcatccatgttgtcacatgtaacagaatttcattattattattattattattattttgagacggagtctcgctctgtcgcccaggctggagtgcagtggcgcgatctcggctcactgcaagctccgcctcccgggttcaggccattctcctgcctcagcctcccgagtagctgggactacaggcgcccacagccacgcccggctaattttttgtatttttagtagagacggggtttcaccgtgttagccaggatggtctcgatcttctgacctcgtgatccgcccgcctcggcctcccgaagtgctgggattacaggcgtgagccaccgcgcccggcccagaatttcattattttttatggctaaataatttgcccttgtgtatatataccacattcttcctcccttgatggacgctaaggttgattctacctcttggctattgtgaacactactgcaataaacatgggagtgcagatatctcttcaacatactcatctcatttcctttgggtatatactcagtagtgggatttctggatcatatggtagttctagttttaatattttaaggaacttccatactgttttccataatggctgtactaatttacattcccaccaacagtgtgtaagggttcccttttctccatatccttgccagcacttgtagctttatcatgcattctgacatttgctgttacctagagcttccaaatcctgaggcattctggtattctacagagtatttcagtttgcttctagtaggggggtctaatatttttgtctatgtaggtttatacctttcaaaagatatatttttagctttttgaagtgagagggtgagcagatctgcatccgagtctcctacattcaactggaagtctacatttaattttttaaatggggatatttaataaaaatttatttggaaagaaatgctgctatagatacagttctatatggaattattgcctttccccggtaatgtctgtaactaaagagtctaaagtttcctttaaactgttgaatactaggaggttttattttacacagaaacccatcctattttttcttagttaatttaataaaataaacacacacgaacatttggtatttttcatttctcctaaagacatagaacttagcctttggagaattcatcagagattgaaggaacctatctctgtgtaccttccgaagttgcctagagtggatttgtcacaaatgctgtggaggaaatttttacatatcaacaagggctaagctcgctccttggagattcacatttcaactctcatttgcacacacatagagtctctggtgcagattgagtttgagttaatgcacatagcttgttgggaagaaatcaatcaaaaacctttttaaggataaatggttctttaggaacagaaagttcagtatctcaattttattataagcattgaataaaaaccattttaaaacatgcagcatattaaaactacaaaaggcgctaataataaaggtattccctcacctaggtcagttggtgatatgtactaagtgatatttagaataaggaaaaaaatcaactgtcatttaatgtctgcctacaacacatgaggcagagtgctagttgtcatattgcaatttgagtaatccaggactctggtgactttagcccaaaacttcacgaacagtattataacagccttgtcattcctacgcttaagaaacctttagcgatgtttttcatggtgtttacaataacatcgaaacaactttccctgacttaaagggcctacaggacctggctctctgtttctgctgtcacttcttcatagcctttttctagctccattggtggtctttctgtttctgtaaatttactaaactttctcctaccttctcagtctcagggcctttgctgctttgcctgaaatgctttttgtatgtctttcacataacttcattgaaattaggccccttaactatgtagtctatcacctcacctgcctcacaccttcatagatcttaccactgttgctagttttctccttccttcctccctccctccttccctctctctcttctttcctattgtttgtcttcctccactgtcttgtaagtcccatgatattaaaactttctccggggctaggcatgttgacccgtacctgtaatcccagcactttgggaggccgaggtgggagaattgcttgaggccaggagtttgagaccagactgggcaatatactgagacccagcttctaaaaaaaaaaaaaaaaaaaaaaattagcttggcattgtggagcatacctgtagtcctagctactcaggaagctgaagctggaggatagcttgagatcaggaggttgaagctgcagtgaggtatgattgtgccactgcactccagcctggatgacacagtgagaccccgtctctaaaccaaaacaaaacaaaaaaaataagcctttcttttgtttattactatatttctagcatcaccactatatttccagcactcagaacagggtctgaaaaataataggcccttgaatacacatttagtaaatgtgttctttcatttcacccataaatattgatcatttactacgtgcttggcactctttaggggctgctgaggatattgcagtaaaccaaacagatagaaggtcttgcttccatagagcttatactctaggagacagacaataaaataaataagtgaaacatgatatagtagatggtaatacttgttatggaggagagaagaggatataatatgtggatgtcagagtgttgcaaatttaaatagcacggtcatgaagatgtttgagcaagaacctatcttggagaagagccttcttggcagaggcaggagtgagtccaaagacttagtggtaggagcatcccaggacatttgtagaagagcaaggaaactagtgtggctggagcagagcgagcaaggaagagtgcagaatgagatgatgtcaggatgaaaacaacaacattcagcttgtctatggtcatataggctgctgcaagaactcttcttctcactctgtgtgagatgggaagccactggagaattttgagcagaaaagtgacaagatccaacctatgatttccatgatgactctggctgtgttgagaatagaccgtggctgaacaggggaagaagcatgaagaccagttaggaagtggttgccatcatcccagcaagaaatgatggtggccgtgtcgaggagaggagcaggggaggaaatgagtgaatgaacgataataaaatttaagaaagaaacgctccatcatcctgttactttgaaatttccgcctatttcttttgtatttgtgtttttccatagccccatgtataaatatatggcataatttttattcagaggataatatgattttgaatctttttcatctaatagcatcggcctgcgtccataggtgcttcaaaatctttttttttttttttttgagatggagtctcactctgttgcccaggctggatacagtggtgcgatctcgtctcactgcaaccttcgccttccgggttcaagtgattctcttgcctcaccctcctgagtagctgggattatgggcgcaagccaccacgcccggctaatttttgtatttttagtagagatggggtttcaccatgttggccaggctggtctggaactcctgacctcaagtgatccacccacctgggcctcccaaggtgctgggattacaggcatgagccaccacacctggcaaaatcttccatttttaatggcagaatgatattctttagagtttctgtgacataatttgttcaattatttctatttagaaatttattattgatttcatttatcactattgtaaataatagagattaaaatcttgatatgtagatttattttctttcctataggttgtttccttaaaataaatacttaagagtaaatttacttcatcaaaggatgcaggtatatgctgttgtggcttttgaaatgcactaacaaattgcgttctaacaaggttgtatgcatgcgggtacctaccggttttacaatagaactggatcagaagtaggtcctgctcgtaagaaagttacaatataatgtgggaagaagatgtgtaaaccatcagctgtaataaaaagcacaatgaagaacagtgtaagaaggtaccacatttagaaaaaccttatcagctttaggtgttattaatttcatttttagtaacttttgcattcattaaataagtaaggctgaatgcaatggctcacgcctgtaatcccagcactttgagaggccgaggcaggtggattgcttgatcccaggagttcaagaccagcctgggcaacatggtgaaaccccatctctaccaaaaaacatacaaattagcagggcatagaatgtgcacctgtagtcccagctactggagaggctgaggagggaggattacttgagcccggggggttgagactgcagtgagccatgattgcgcaactgcactccatcctgagtgacagtgagaacctgaagtaagtaagtaaataagtaaataaataaagcgtgactggttgtttaattttaccaatttgcttttttgtttttacctctcttgatataaattacccacatatcaaggcccttcacccattaggctattaagattttgattttttctcattctcctaaaaagacacatgcacacgtatgtttattgcagcactactcgcaacagcaaagacttggaagcaacccaaatgtccatcagtgatagactggataaagaaaatgtggcacatatacaccatggaacactatgcagccataaaaaggatgaattaatgtcctttgcagggacatggatgaaactggaaaccatcattctcagcaaactaacacaagaacagaaaatcaaacgccacatgttctcactcataggtgggaggtgaacgatgagaacacaggggcacaggcacaggcagggaaacatcgtgcaccagggcctgtcgggggtggggggctaggggagggataacattaggagaaagagctaatgtagatgacgggttgatgggtgtagcaaaccaccatggcacgtgtatacctatgtaacaaacctgcaagttctgcacatgtatcccagaacttaaagtataataataaaaaagattttgatttttttcttatcaattaggtaagtttttgttgcttattattcatagacacttacttagctagaaaacaattctgctactctctgatcctcatctttgtacatttgtaagtagtggcgttcctttgtaaggtaatgtagatgggcaaaatagttcacataatttgtcttactgaaataaactttatacagagaagtacaaaagagttaacacaaatttaggaggtatacaatgttaagtgtacatcagttaaccgaacaaatatttattgaagcacttaatagatattattctagggttgggaatatgatgaataaggttgtagtttccaattgtttaacaatttgaaaattactcataaggaatagtagatatataaataaatttcagcagtgtaatatataattgaatagaggtgaacacagagttctttggaaataaaactggataaaagtatttatagagctaagcaatgaaaaaattctaatggcctcagctgtgaaataaaaataatacaaaatgaataaggcagacaactcaatagaaaattgggcagacgacttgaactaaccacaaaagaggatattccaaattgccaacaaatagatggaaaggtgcttaacttcactagtcatgaaggaaatgcaaatttaagccacaacatgattcaactatttaccccctcccctctagaatggctaaaatcaaaaagcatttagacaagcagaactctcatagactgctggagggagtatacatttgtatggccaccttggaaaactatttaacagtatcttctaaagctgaatatacttgtatccaatgacccagcaatccactcctaggtattaagttgtcatcttagtaggtaaacaatggttgaatattggcaattttatattgcttaacctaacgtatacccagcagaaatgcacacctatgttcaccaaaagatgtggaagaatttcatagaagcactataagagtcccaaaatagaaagtatccaaatgcccatcaacaacagagaaggtaaataatcgaatactgatctacaataacaagaacaaacaaactgcaactacatgcaacaagatgagtgtttctcacaaacataagttggatgaaaaaagccaaacacaagagagaacatacttcatgattctacttacataaaatataaaaatatgcaaaacgaatctgttagaagtcagaggagtggttactccttgggggttaggaactggaagggttcacaaggtggggcttttgaagttctggtaatgttgggtttcttgatctggatgctttttacattaatgatttgtgcacttttgtatatgtatgtgtattgcatcaaaaagttttaaaaaaataacattaaaataaatataagaaagtccaagtaagtcctcattttttccccacaacaatcactttgatgcttttctagggaaatactgaatatcaaattcttttaaaaagcttttctcccctcatttttggagccctttttttgctggcaatggtaggtaatcctgtacttgttgtaggaacacaggtaagagactaaactgggtgtggggtcctggctgggaagctttcctggaagagatgaagctggacctgagttttgtagcatccatcagagacagccagggaagcaagtggatggcagacagttccagggagagaggccaggctactcgaaagcgaaaaggtatggtagggaaagaaagagaacccactgagagggagtggacagagcttgctggagctagagcttgaagagtagctgaggaggggttaatgattgataagcaagagagtttggcaaaggtcagacagagaaagatcttaaagggtcatgatactgagcttggacttaatcttgtaggcatctgggaaccactgaccaatttaaatcaaacaggtgacacaattaagtttctacttaataaagagtaagatggtgatggtgtgagaaatacttgaagagggttaagaagactggagcctgggggaccagttaggaggccattgcagtaatccatgggagatacggcaggctggtggtatgggatggagaagtagggatagacatgagagctattgaggagacagttgttctgacaggactcagtaattgatgggtttgaaattgacatgtaggcatggtacttttttttctagtaaaaaaaaattggtagaaccttaattatgataaatgataaaacacatgtgcctttgtccttattcccccctttaacacctttttacaggtgtatacatcaaaggatgttgccatgacgaacgagagaacgcttaccaatgatttcccattgctgcttggaatgaaaacccaatgacacatttcaaaattttgcagtggtaaatcatgtaggtcatcttattgcactaccatgcaaacttcttgattttgccaaatcagtcagttgagaggaaaaaggaaaaaagtgttacctatatatactgtcatatactattgtaaacaaaaaacaatccgtatataggtttatatgattatacagtacaaaactatgtacacacatgaacaaacatacatatatgtatatacacactagaagcttaaacagctatgtgacacttgagatttttatatacagactttaccagggtatacaaaaaataacataaatttttacttaattttccctgtctttttaatggttccatttgggtgggggaggatccagaggattttttcctcactttaattacctcattgcatttccttcttttcgattttggtttttataagcgggaacactgtgttaatccattctaattaaaacccagccatgcaacccttcagttaaataaacaatttttgagtctgcctaggatatcatttagtcagaaattgtctctatggctttggaaatgatcaccactacagtgctctggtagccacaggggcaatgtcttcacaggctgattttctaaaaataccaggaattggccaagagcccttgttctggggaagggttcagagttcttccacaggggcctaacagagtgcagaaatgtatattcctatagaaaaagaagagggtaggagttatggaaggggcaaaagaaatgacccaagtgcacctcctgcttgtccacagaacacctctttgccttccggctgctggaggagctatgctattcttagccatctcccgtgaaggcaattacacaaaccccctctgaaacccatttccacatttgttcaagaaattcttttatcttatgtaaatcccccatgctgtaactaagcccttggtctgcccttggccagatgggagggcagccaggcttcctctctccagcagagccctttctgtacccaaagatgattatcttatcatcgtgccatcctccctcccattctccagactgaaaattttcatctttagctttttcctttccttctccttcttatcatttctatgatcccctttaactgttgccaaacacttttcagaactgaacctagtactatgcaaaaagtctatctgatcttgttctccaactgatggggacaaggcaggttaaaaaaatgtctgagaaagcaacagggagagtagaggtaggtgctgcttgcgcacagctgtggaataaagctgattacaactgagtccaaaaccaaggccccaatccaaggccgcgtcgtaaaaaaaaaaaaaaaaaaaaaaagagagaaaagtaaaaagaaagccaagcccgaagtccttgctggttcaaaggcccagggagaatccagaggaattgttctgtaaggggagcaggcctggatgtgggctgagtagtgagtggacagctgcagccttctttgaagcaaatctagatcttacagtcctgggctgggaaggggcaggcatctcacaaacagctgaagaaccgaccagcagtaagttcaggagactgttcggattaccttgtgagactaagtcaaaactcctccatgtcactaaacatgtgcctcagaccttctagtggaccaggaccaaacttaagagggtgtagagcaagcagatgggccccaacccaaatggtccctccctagttggaccatgtgatagtctcttgggcttgaaaacttcagtcctctctttccctcctctccattgccttaatcaccaaactgtgactcttcaatgtttctcatgctcattcctttttgcttctattttccccagtcaaacctgaacaatctcggtcctgaacagtaaattgcttcctaataggactttcgattcctattcctgtttgccaatctatgccacattctgctgtctttcttttatacttttacttgaggattttgaattacctatagggataagtttatattgctccttagtgcatccagaccctccaacatttggccctaaactagctttcccgaccatatctcccattgcttctttatgagtcctctattgagtcaagcatattgccctttctatgcctgtctttgtccatgttgttccctgacttggaaggcgagtggctctgctctgtgtgcatgtaaatcctatcttgaaagatgaagatctgattttagtttatccaagatcatcttgaccaaaatttctttatgtccccagatttcttacagcactttctgtcagtttccctcatctaatcttatactataccgggctgttagttggctttaatatgtgtctgttgtcttccctggctagtgtcttaaatactttgatggcaaaggtggacttttggagttaaggaaatcattccaaagagcttagcattgttctggaggtactgagtttgctgtggcttcagcgtagttcacaatgctacagtgcggtgattctcaatattcttcaagatgaagatctctttgttccctttccattgtcaataaacgagtgtgttgtggttcactgattaacatttttaaaagtaccttaatgatgagatgctttcatgaatttgctaatgctttacaatgaagttttatttaggtatagcatcaccaccatgtactcgaaaattagtagtgctgtaactgtatttaagatgtctttatttatttggtctaatacttagccagcatgtggctttgctcacccttacaatgatgttggctctttatgtgtcctgctgccccactatttgggcatattattattattattacctcacagggctgttgtgagggttaaatgagatatatattaggtacatggcacagtgcttggctgaaagtgattttgatctttctttcccttcctcatgccaccatcagctaatttagaagatgggaatgttctgggacctctgggacagagcttagggcagtggatgtgggaaggcatggtgctgtctctggaagagaagggcattaaagatcacctagagcagcagttctcaaacgttttacttgcaggactcctctaccctaccctcttaaatattattgaggaccccaaagagcttttgtttatgtggagtatgtctatcaagaaactttaaaaaatatgtttaaatttaaaagtaacaataacaaacccattatacattaatgtatataacacatttttatgaaaaataactatatctttcaaaacattagtgagaagagtgggattgttttaaatttttgcaaatctccttaatgtctggtttaatagaagacagctgattcttgattctgtttctgcattcaatctcctttaacacagatggaccccaacttaaaatggtacaacttaggatttttgattttacaacggtgtgaaagcgatacatattcactagaaaccatacttcaagggcccatacaaccattctgtttttcactttcagtacagtaaagtccatgagatattcaaccctttataataaaatacactttgtattagatgatttcgcccaactgtaagctaatgtaagtgttctgaacatgtttaaggtgggctaagctatgacgtccagtaggttaggtgtagtaaatgcatttttgacttatgatattttcaacttatgataggtttatcaggacataaccccatcgtaagtcaaggagcatctgtatttggttttggtgaaatataggaagaaaatataggttcatacagatatattgttgaaaaagggaaagggcataagagtatttgaataggttttcagataattgtggatattcttctttgaaatgaaaccaaaactcaacaagtggtagtttaagaaatgttttcaattgtaacttgataaattatagttgtatatatttatggggtacaatgtgatgtcatgatttatgaataaaatggggaataatgaagtcaaaataattaacagtttctgtagtgagaacacttgaaatttactcagcgatattaaaaggtgcaatacactattaacagttaaagattacttgcaatgcagaatctaaaacatatcaatgaagttttcatgctctgttacaacaaaatccattgctatctttatttcaatgtgtcttttaatcatttatgattttgtaacaccaaaccttgggcacttggaaaatattgagtgcaccaaattatgcagatcttccaaatataagcacatttcattatacaattttaaaacattgtcttgattattaatcaccactgatcttatcagataagtttttagtgctgggaagctgttaggctcacggtggcaaatacaagattttccaaattccaattttcattcaaaagcttgaatgttatcattggcaataaatactgccagttattttctttgaagttactggccaatttagttcatttttttgagaaagtatctgccaaatacccaatttcgaataaccacagtctgtcagttgttcttccaaataaaaatagtgttcctcaaaaaaaagcagataggccaggtgcggtggctcacgcctataatcacagcactttgggaggccaaggcgggtggattgcctgaggtcaggagttcaagaccagtctggccaacatggtgaaaccccatctctactgggaaaaaaaaaaaaaaaaaaaattagccgggcgtggtggtgtgcacctgtaatcccagctactcaggaggctgaggcagggaaattgcttgagctagggaggtggagggtgcagtgagccgagatcgtgccaccacactccagcctgggtgacagagagagtctccatctcaaaaaaaaaaaaaaaaaacagatagttcaccttccaactcaaatgatggcattagtgcttttccttgagacagccattgtacttcagtgtgcagcgaaagtgctttatgtgtactttccattttgtcacacaagatatgaaaaagatctatactcatgagttgacatttaataacaataattgttagcacttcaccaaggacattttaaaatgaaactgacattttctttttactatgtagcagtaagaaaatacaccgactactagtatagtttggtcccattaccttgattcatgctaaggtgccagcagttttacccatcattgcttttgcaccatcgtcacaaatgtcaaatggtgaaaaaggcaaataacatctttctattattatggaaatagttttgacctcaatgaccctcagaaaagtccctgagaatccccaagggtctgtggaccatgttttgaggaccactgctcttaaacttttgcaaagggccagccctcccaggacgcagaatgtagctactcccacatttgggaggagaggtgaggtctccttcaaacagggcaatttgccttcctttttggaacccgagatggactttttatttccttgcagaactgaaggcatctggcttgggagcacgattattctccactcacctttaaactgcctcagctattactaagtctctggcagtgatatgttgattatgtgaatttaaagcccacaggagccagaggaatgacagatcagtttctcttaaatgagaaataaaatccaggagcctggcagcgggacatacggctctcactcctgctgacctttgatgtcactcgggtagaatgactgcttctaggccagatggcatgtagcttaaacggagatgtctcaacctgtttccttgtattaattgtgcacattgatactcctccattgtgtagtccataattcttcatcgtcaacctcatttggatttttttttgaggggaagctgagctcaagcaggcctccacgaattcaagctatttcaaaagctccaaacccaaacctttttctatccaatcactgttataggctgacagacactgaatctcccttctgtcaattgaatgtaagtctagcaacttttaagagcaatgagattgaaggaaagggccttctttcacctctttgccctaaaggaggtggctgaatggaagcccatttaattttttgtttaaaggtactaaataaggatcaatttgtaaagacggctctctgagtgtagcaagatagtttcttaaatctgatagggataaatgggaggtcaatatcctttttcttatcaacaatttcaccaaataatatttactaagaactttcacatcgggtttctcagctataaacaagcaaacactccaagcagagatattggaagtgctgaaccaggacagttgctgggtatggagctagaagctaacatcgcttgtctatggaaaagcatgctttcattactcaaaagctgaacttttaatttatttctaaatcaatttgaagcagacccaatgagcgagaaatgcaaatgtagtcaactgggaaaagaagctgacttttttcactcagggtcatgggtaaggatagaattctgccacgtgaaaaatgtctcagttttgacaaaaaaaaattaacactgcttcaaggaaagagaaaataagttatggacgttatatctgacagatttttccctttgtattcatggcatttgaattatatgcacatcactaaaaaaatattgaaccctcataaagagcctggcaagtgagtaactgtaattttaaaacaggaacattcgcatatgttttaaagctgttttagtttttgctcagaattctggttcactatttataatagggcagaacatccatgcttttgtaagaaccactttggcttatagaaaatacagtaccggccaggcatgctagctcacgtctgtaatcccagcactttgggaggccgaggctggcagatcgcctgaggtcgggagttcgagaccagcctgaccaaccaacaaggagaaactctgtctctactaaaaatacaaaattagccgggagtggtggcacatgcccgtaatcccagctaatcgggaggctgaggcagaagaatcgcttgaacccgggaagtggaggttgcggtgagctgagatcgcgccattgcactccagcctgggcaacaagagcaaaacttcatctccaaaaaaaaaaaaaaaaaatacagtaccgctttaaaagtttctaagccaacagaaattcaaatgatctaaaacttaaatcaacatataatggtttgagagaaaaacatgcattggccttagtgtttaggtaggttaggtatgtttggagactccatgagaggagcccataaggaatttgtttgcacgagggatgaagttgcttcctgtgaatgaacgaaccctaagacagagtagcattgatgggatattgagaaggtcaagaactaggggacagtatcagaggcaaggggcactgttcatttaaatttaaactagccaccatgagcttataacccgagtccttggtagaggagcaataactaagagcaagcgaaggaatgatttcagaataatctctttaagacactggggagaataaacctgaaatgttttgtaggccatgtaatagagtgaaatgaaagggagcacagaagtccatttaccttcttggactcagtggccccttcagtgagtattgtgtctttgctggggcaattgtgactttgcatattgatggacactggtgcctttggtggttattggggcattgttgcgttttcaccattagtgaagtcaagagtcaacaacttggccaggcgcggtggctcacgcctgtaatctcaccactttggaaggccgaggtgggtggatcacctgaagtcaggagtttgagaccagcccggccaacgtggtgaaaccccgtctctactaaaaatacaaaaattagccaggtgtggtggcacatgcctatagtcccatctacttggaaggaaaaaaaaaaaaaaaaaaaaaaaaaaaagagtcaacaacccaacaagccagagccagggaaaaggaaaatgatcactgctatgtggtaactgagtactgaaaccaacataattctctgtcgctgtgtaaaacaataacagacgtgggaatagttttctgttcccatattaatccatgttgagaataagcaaacttagctacttgctccaggaaatactttttcctgaaaattaaaattgtaaaccaactaaaagagtttacttaacaagaataccaccttccccatcaaaacttgcttcaatattctcctcctgctatgcccaccaatctacagctattacgtcacaaaatctacccaatcccaattagaggcctgccttgcaagacccgccctgaaaccacccaacttagtccctaataacctatcctgtcatttcccctctgagacactgcctagacaccattaaggcagagttctctcatactgcagtaagtctcataagatacttcactttgatggatcagtgatgtttttctagtattttaggggagggcacggagtaggggttgacagccaacgaagctaaaagggtgaatgtctgcacattcaggagaatagaggtgccacaattatgggtggagtggaggcagaaaaatatggtgtgttgctgtttttacgatccagtttgtacttagaggcaaggtaagatgtgaggaaatgtgggctaaatacccataaccctttttaaaattaagcaagaacagcaaatgtctaaaaaatgtctagcccagtgaagttaccatctattcactcctgttttttttttttttttttttttttttttttttttttttttgagacagagtctcactctgtcgcccaggctggagtgcagtgacgcgatctcagctcactgcaacctctgcctcccacgctcaagcgattctcctgcctcctgagtagctgagattacaggcgcgtgccaccatgcctagctaattcttgtatttttagtggagatgggttttcaccatgttggccaggctggtctggaactcctggcctcaaacgatctgcctgcctcggccttccaaagtgctgggattacaggagtgagccaaggcgcctgacactattcactgccttttacatgatttttccttgacgagataaatgtaatgctcccttcttccagacaaaggtgattttaaacttactgtatcgtgaaatcacaaaatcttaaaaggtatgtgtattttgtgtgtatgtatatatacatgcacacacacagacatatcatcctatcttattccaatgagtgatttaaggtagttcacaaaaatgcaataggataaaaataagtcagtcctagaaggcaaagctctgcagggcctgctgggaatttattccccacgcccatcagtttctgtttccatgaagacccctttctctttgagtactgaagagcagcatcagcaacctcaacactgaagctttttctttctctgcccaaattccctcactagagtggtgggacagggtaggtgaggagagaaggaagcccttaaacgtcaaagcagtggagggttggggaggcatcggatcgcactttcgcctcctaggctggggaagatggtgcacatgcgttgtaatgcgcacgtgttactggcacatgactcccggtcccttgtgagccgaaacttggatcctaatgacgttgataatgggttactaggcactcatagttctggatcgttgggtggccttcacgttagcagaagaattcctttaaacgtcatttttgaggaagtagacaaacctaaatatgtgtctgaactccaaggaatatgaacaagatgcctgctggtgaacaagaatgtgaatataacaaagaagggaagtactactctaaaggagttaaactggtgagaaaaaagaaaaaaattcctggttaccgttggggggacattaagataaacatcataggtgaaaaggatgatttaccaattcatttctgtgacaaatgtgatttgcctattaaaatctatgggcgaataattccgtgcaagcatgctttttgctatcactgtgctaatttatatgacaaagtcggatataaagtatgtccgcgctgtcgttatcctgtgctgagaattgaggcgcataaacgaggttctgtcttcatgtgtagtattgttcagcagtgcaagagaacatacttgtctcagaaaagcttacaggctcatatcaaacgccgccataagagagctcgaaaacaagttaccagcgcttcgcttgaaaaagttcgtcctcatattgctccgccacaaactgaaatctctgacatccctaaaagactgcaagacagggaccatctaagctatattccaccagaacagcacaccatggtgtcactaccgtctgtgcaacatatgctacaagagcaacataatcagccacataaggatatccaggctcctcccccagaactatctctaagtctgccttttcccatccagtgggaaaccgttagtatttttacgagaaaacatggcaatttaacagttgatcatattcagaataactcagattctggtgctaagaagccaacacctcccgactattatcctgagtgtcaaagtcaaccagcggtatcgtcccctcatcatattatacctcagaaacagcattatgcgccacctccatctccatcatcaccagtaaaccatcaaatgccatatcctcctcaggatgtagttactcctaactcggttcgtagccaagtgccagctctaaccacgacctacgatccatcatctggatatattattgtaaaggtgccacctgatatgaattctcctccactacgtgctccccagtctcaaaatggtaatccatctgcaagtgaatttgcttctcaccattataaccttaacattttacctcagttcaccgaaaatcaagaaaccttgagccctcagtttacacaaacagatgcaatggatcatagaaggtggcctgcatggaaacgactgtcaccttgtccaccaacgcggagtccacctccttcaaccctacatggtcgatcacatcattcacaccagagaagacatagacggtattaaggatgataacagtatttggaactgaagacctgatgggaaaaaaaccttcaagttctatactgtactgtggataagcggctcagttcagcagagctggagttgaacaactttgttcctctggtgtggtaaattgacctaaaggtgacctctgacgatttcctgaaataaatatgcaatgttacattttcaaaagtattgtggtttttatttttttattttttggtgatatgttaacctgtgtaaaagggttaaatttcaatacagctgtaaaaatgctattttatgtgaactcaagcatagtcacatgctgtttcttaaacatattttaccactgatttcccaaagtacaatacaaatcctagaggtaaaaatctactacaatgtacagttaaagcagacagctaaatggtagataattatttcacattttaggaactgaaattttaaggtacaataagtgtatagtgcatttcgtttggatgccttttcatttttaggcagccgcagaagcaccaaaatatatcagaattccagtactatgatagatttaagtttgcaatgttaaaaagcattactaaatcatttggaaagatatggccaaagtaattgtatctgtaggctccaagctagtggggacaatgttacttgttaatgcttttttttttttttttacagaatcgttcaaatcacataatgtaccacactactcttaagtagcattattttatagcactgtttaaatggcgtcatttacatgaagtgtgttctactttgctcatgctcctaaattaaatattcaggactgaataaactttattataattcttcatttcatggtagagtttgatcctgttcttatgtggttttttttgtttattaggttttaaactacagtttgaatgccatggaggaatttggataatctattaatgagaggcattgttacagttacagacttggacttgcttgggttgcattattgtgtgataagggtttttcctctaacttgaaattaaaaactactaattctttcctatttcttttcttggtaaacagtctaaacttgggacattttagcacgaagttaacagtaaagactactagatgactttgtattggagaaaagtaatgacatatgaatttcactgctttattaagtgtctttagaatgagcttttgcattttaggggcttattgcagtccagctatgatgaccacttacacttatacttctgtactttgtatagaattcatatggatgagctgaggttcttagggtattttatatcgtttgaataaaccctcatgaagatttttctcccctttcagtagtgcataatataaatatgaaatgtatagtatgcagatattatttactagatggtttatagtacataaatttgggagatatttctttttagcaaaggatgaactgacggctaacttatcattttactctgttgggtacaggcaaaataaattcttgtcttggctgatcagatgctctctgagcttagagctgaagttagaaatatataaatggccattttaaccttgaccagcctaaaataagtaatagactcttttttaagtgagtgatttttcatacctagcaatttgagagtctaatgttaatgcactatttctagtgaaaaagccttgttattaggagcatggcatgtgattatgcgaaatgttggttggtaaatgcttctattatattattataggtacttggactggtacacacttgatttcctttcttacctctacttagaagctgttaaaatattactgttaaaatccaatataattttttgtttcatgtaataaaagccaaattcaatttaagtcttctcaactatctatgaagagctcttctatgtttattgacattctccaggattgaaggcagtatgaaaccacttaaatgatgcattagacaaaaaaaagtatccttatgaaattttacatgttaaaagaagcctttaaaaattatttattttcagttaggtttaggcaatatgttattcagcaaagcagaacagatgaatgtgttgtaggagataaaatttttaaatgatattggttatgaactcatccagttatgtttgaatgatagtgatgggtaaaagaatcacaaaattaccattagtgtttctttaagggaaaaataatatgaatcctttccttttactcagagaaggctttgaagctataatgagtataagtctaaattaaatttatgtatgctacattacattgctctgaagactactgaggtggcagtttaagtctgaaaaacaatatggatccataaatactaaaaaataaacagaaataccagggaaagggaaaatgaaggtcggataaatagtaaaattgagtccaagttaaagttggaagcaaaaaatttgcacaattgcttcctgcactgttgttaatgatggatgaaaagtgtctaaagcaaacaggcaagataaaagcacgcacatttcacgggaagcataagtgtgatactgagcaaaagttctcttgtggtgctcataaaatggtcattaatatagggttgtgattcctgattctgacagcatgcatctcctggagcatcaccacaaattagcatcctttgctttacttattttcaaaagattctgaatcagtaggttttggcaatggatagggtttagtaatctgttctttcagtaagtatcctaggtgattcagaaacagctgactcaaaaatttcgtcactggacacccagtctctagtctcagtggtctaccatccattctgtacccagcaaccaaggtaatcgtttaagaatggaactcggccaggcacggtggctcacacctgtaatcccagcactttggcaggccgaggcaggtggatcacgaggtcaggagtttgagaccagcctggccaacatggtctctactaaagatacaaaaaattagctaggcgcctgtaatctcagctactcgggaggctgaggcaggagaattgcttgaacccgggaggtggaggttgcaatgagctgagatcgcgccacggcactccaacctgggcaacagagcgagactctgtctcagaaaaaaaaaaaaaaaaaaaaaaaaaaaagaatggaactcagccctcaaatagttttgtgttgcacttcaagtccaattcctttttcatgactgtatatggttaaactcctagtgaattttcaaaactcataacctacccttctctctccgttccccctgttccagccatacaaacttaaaaaaaaaaatccttggaccaccaaattccttcctgcctcacgttttacagttattgctttttttttttctttttttttttttttccccctgcctggaccatcttcctacaaatcttcttaaggctggctctctcacttcatgtttctgttcaaatgccttccctggctaccctgtggaaaatagcactgccctccacacacccatctcctaaccctgctttattttccttcattctctatcactacctgttattacataactaattactaattgctttttttttgtttcctccaaaaaaatgttatctccaggagaggtgggtctttgtactagtccattgaagaaggatgaagagtgatatataacaaagcagttttatttttcgttcttgctgttttcttctttttacattttattctttccgaggtgaaaattggggccatctcataactttcctctacagtcttaaatggaaagctctctgatcagttattaaaatgtccagtctgatgggacagtcaaactttagaactgatttaagggtgagtcctttccttacttccctagctgtggctggtggaagaccagcagttaggaagaatgttgtggtcaacttcttgccttaaccacctttgctttgatttcttctcccctatttcatcaggtggaggtcttggtccttcagagttggaatgcaaaggattggggcaggagaggtgagggaagtaggaaaagtcttaacttggttggtactatatgaaactgggttagtagtttctgggcccaacttcaggttttaagaattaattttttctttcattgacactttcatggttggtaagaaagaattgctctcattgatccagatctctacttgtagttcccgtgatgaatatgaatgcttctctcttccagttagttccctagttcttcctcagcccctgagaatctggcaatacctacaacttctcttagctgagttgtgtttatccctccagctccctctagtgaggggccatacctggcccatgagaaacacatctccttttcccggataaactctgcgtgtgctggccaatctcagtgttgccagcttcctttccctcagctgtcaaagaaattagcctgtctcctgcacctttgattttccagacaccagtccacagtgtccctaatgttccagagaacaaatatttagcccttggagtgggtctcattaaagcacctctctcctgggaggtgatgtgggaggcatccttcatcccttttctaagaggaatggtggtggtagaactcacagcatagcaaaatttagagtcagactgtgttcttattggccggtgctcatgacctactgtttgttaaataattttattattactctagatccaactatgctttattttcacatggctcagaaaccccagatgggaaaatgcaatctgtttgaattgcgtctacaaaaacaaaggaaggagaagtgcacaattaaatggataattcagaaaaaaatgcctcaggtattgaaatgttcttggcaaaattttagtatctgaatcattctaaaaagtgtcagaatttggcacatctcctaacggttccagtaacattatgctgagtaaaattatacatttttttctttgacaaaatagtcaatagatatatttcatttccaatagaaagaactaagtcatttttttaagtatctttcaaggtcagccctaggtaaaaatgtggtatagatggagttctatttggatgggataaagtagaggtataaaactttttccctctactgaataaaactagcatttctcatcacatatcatcacacaataagaaacagatggtctgcttattttgctgaccatcgctcatttgtgtttaaacttttcccctaataattgacttgggtattctgtttggtttatgcatatggcagactgattgcaaaattggccgcaattctttaccccttcccatgtgtcttcacagttcctcctatcaagaggtagtgtctattttctcacctctttgaatatgatttactttggccaatagaatgtggtagaagtgtcagcgtaccaggtctgagcatagagggcttctgtcctcccacctccttttagagcactgcctccatgagagcaaacttggcccaccttgctgaaagatgacaaaacacactgaaaactcattttccccccattcaaagccatcctagaccaacttgcagtcagctaactccaaaacatgtgagaatgcccaaccaagattagcatagctaccaacccaacccaacccaaagatgactgcagacccatgcaggagcccagctgagaccagaagaactacccagattatctgtagttttatgagcaataatataaatgcttattgttttaagtaactgagttttgggatgatgggttacacagcagtagctaactgatacaagccatttttactcccatttccccccgtagttagagaattacacactgtccagttttacaataaaattagcactaatgtgagatgttttcaagatatgaattataaatatttgatgtttagacatgaaaagaattcacctttgaaagggtttttaagtagtaaacattttcttcaggttttgtcatcttcacctatttttcaattttctcattaatagtcaagttataaggaggattaatcttcagtaaactgcacagtaaccttgagcaaattgcagaggatttagcttaagcaggcattgcatatgtagctggtgttacctacagtcttggtatacatgtgaagtaccatgcttataagcataaattcttattcctaattttatcttctgaataggtgtctttggatctcctgtatttgtgggagccctttatataatagccaagctctggtggcctgatcttactttgaagatttagccctaagttttgtgacagggctgcattcacgtagtacatacagccatagtcactgtggagcacagtctttatctttgcatttaaggaggttcaagtcagcatgggctaccttagaggaaaaaccttttaacctcatcctttcatggttcccaacaatttgaaacagctttccaaattgatgtcctcaaactttctcttccctgtttagtccagcctttccacctctctctgttatattttaacacatatgagaaagctattagtcccctagttgtgcataagcctagatgtctgacaccaaggctgacatcactttggatgccacttgactccatattagacagtgaggaggcagttgggcaaacatctgttttaggaaccaatatcagcataatctcaggtttccattagaatatacttaaaaatacttgtatttttaattaagaaaattagctttaaaatatttttcatgttttagtttataagagcactacatgcacattattaaatacaaacacaatataggaaaggataaatgcaaattaaagcaatctgtgattctataggtgatttttttctgtatatatttttacatgcatttatatggtgctctgcaaaagttcccagaatgcaccttttctgtaatctattattaattattatttaaattaaattacagggtcaacttttgagtttcaacttctgaaagcaaatgacttatttgcattttagtacataatgccatttgatatgctttagttggggctcaatatacacaaattatttaatttcttactgctatgtctatatggtctctctttttttttttttttttttttttttttttgagacggagtctccctctgtcgcccaggccggactgcggactgcagtggcgcaatctcggctcactgcaagctccgcttcccgggttcacgccattctcctgcctcagcctcccgagtagctgggactacaggcgcccgccaccgcgcctggctaattttttgtatttttagtagagacggggtttcaccatgttagccaggatggtctcgatctcctgacctcatgatccacccgcctcggcctcccaaagtgctgggattacaggcgtgagccaccgcgcccggcctatatggtctcttaaaattaaaaacattgactctaatttagtccataccttgccctatgttgtactgcaatcagtatgcctggttctgtcttcagtgtaaagacagaacatatccacaatccccgggaatggaacaaaatggtagccaactctaaaacgtgctttgagaaggagcatccatctcagtcactatgattactagtaggtgcattctatcacaaatgagtcatcactaaatccttacttactctgctttccctttcccatgcttttgactctgaaagagaccggccacacattaggcatggggaagaatgagaggacattgcacactgttttacaaaaagcatctgacaaaacaaaaccattttttatttttaagaagtctttaagtaaacatttttatttgatttgaacactattttattttgtgctttgatatcctggtaacttatagctaattaaaaccctcatctggccatattcccttgggtataatgtaggcactttatgccctgtgaatcctaactcaatcatcacctctcccagacagtaggctcctcctctaggcattcctctcttggtgaatggttccaatagccaaccaaatgtataagcccgaaccttggcagtcattctcttttcttccacactccattttcacttcccatatttaactggtaaccatggtctacagactctatctttatgcttctctcatggccatgccatccaaaccattgcctttaccatggtgctggcactcgttgctcctcaggtggactcctggaagagccttcttattgctttctctgcttctggtcttatcaccagccccactcatccaacacagctgccaagtatgccttctaatgtggaagtctgtttttagacatcagtggatcgctgtagcatttgggataatgtcagactcctttgcttagcacagaaaggccctcatatccggcctgtttccctctctggcttcatttcccaccacctgcccttgggcattcttttctccggttataccttttcactgtcctaaaaacaaaagcagtttctcctttatgtcttcttatatggggttgccctctgccagacatattcttttcctttgtttccccctctcacttttccgtgtcttgtcttttttcttattcacttcttttaaaaatctttctccagacaagcacatgattttgatgcctcttcactgtgattgctggactattcgtgtgcttacatcgtgccagttagcacactgtattttagttgtttacacgcctttctcttccactagaccagtgggcctcaaaatgaccagcaatatcagcagcatcatcggggaatttgttagaaatgcaaattcccaggccacaccccagatcataagctctgagggtgagacccagcaatttgtgtcaagaatacagcattcaatattttgtgataggaaaagactggcaggccatggtggcatgcctgggaatgatttggaagaagatgcatgaatgctacatgaacactgtcctctgtgccagcttttcttaaatagaccaacaacactaaagaagtccagaatgcccagaagcatttcaacacttgtattcatttgctgctatagcaaattaccacaaatttagtggcttaaaacaataaaagttcattatcctacaactttggaggtcagaagtctgaagtaggtctcactgggctaacatcaaggtgttagcaaggctgagttcctcctggagacttgaggggaggacccgtttctgagctttttccagcttctagaggctgcctacattccttggctcatggcctcttcctctatcttcaaagccggcaatggctggttgaatctttttcatggtgccatctctctgtttctgacttttctgcttcctcttctctatttttaaggacctgtgtgattccattggatccacctggataatccaagctaatctccttattttaagtcagctgactagcaaacttaatttcgtcttgctgtgtaaatcatatatacacagattccagagatcaggatgtggacttttatggagggtagaaagggatattattctgccaaccacaaaatttattcttgacttttggagatttgattaaaattgatattgccttttgccttaactctcaagctctttggagaaatctaggattcccttttttcattgtctttccttgtgaagaaaatggtttgaaaactttgtggtgatttagtacgttttattgaaaaggggatccctgcccccagaacttacagtagtggctaataggagagaaggaccagtccaacatggacaagtttggacctacactggtcagtaccgaaatgtatttgtggatggtgtaccagtgacacgatgagagaaagtaaattgcaaccgaacaagcttgctatcatttattatccttaagcaacggtttcatcaattttctggtgagaaaggaagagtagttaaactagaatccctctaaatctgtttgtgactatgcatgcctaatatttacagttgccctgtttgtagaatatgcttaagtttactctgcgctgtgaattcaatacataattttcaaattaagtgcaagactacttacctcaagctgagtttattctgtactgtgaattcaatagttaatttttaaaaacatatttactaatcctgaattgaaagctcccttcgggtattgttaaggagaacaatgtgtactaggtagaatatatctgacatttttacttactatcttacatcaaaatagaaagccctggcaaacagtacctttagccactgaagcagaggccagaacaaaatttctttcagtttaagtgtgttgaaggtaataaagactgtggttttagttgaaggaagagaagttgtgagaaaattacctggcaatctaagcacacaatgtcaaattatttaccttatatggcttttattttagggcaatacattgttatgttctgatcttgagggtaactttttggcttcattttgcatgtgttattagagccaaacatgatcacccagattgttataactgcagaagtttaggggccattggggttgtggattcactctggaaggataatgcatctgtaataacacaatgcaacagtgacatatgaagctaagaaatgttaccttgggttcaacgcatggaccacttggctaaaccggaacatagatgaggagaggggtgtaagaggacattgatttttttttacattcctatagtcctttcacaaagggaatgtgtaggacatgttttcttttgacagaccagctttcattccctttgttcacgaatctgtctcagagaagaagttcacgcttctaagaaatgactttgttcccctcaccaggctccaaatggaaacttttcaaggccatatttgctgtgagagatatttatcatggaagttaagtaacttatgatttaattcaagtgtcctttcagcattgagaacaggttattttctccaggaggccccagcaggttcctgttttaaagaaattgaaaagaaatatattgctttcaacagcccccaaatcaataccccttcaaatatagatgggaccaagtttcttacacttcttatgtggactgaagaatgctgctgacctgaagtcctgtgcgatcataatacttagacttcagccattgtactctgtggtatgaatgactgtgactcttcccttgccattccagattaaagtgaccaacccttgtgcacaccacacagtaatgatggtctctcatccacccatatttagaaactcccctatagaataaatttaggatcagaccatttaaacatcaaaatgtattttgtttccttcaccttttaaaaaagcaacatagggagaatctcagtcagtgcttgactaaataatatgtgtaataaatatggtaattagctgcaaagtcctttataacagagtaccaatgttttatttatcttcccatcttcctcagaatctaactgtggctttcacagaaaagctcaatatatgcctattaaataaatgaatcaatcacttcacacaccaatgctataaaaatgtccacttgtttttggacttgacgtgtagatttttggtgctgggagaaggatcttgattcttttgtacagtttccatttttctactgagattctgaaaactgatttttatctctttgaatttggtgagcatgtttattttaaagtgtttgtctgatatctccagtatccttccttgttattctatttctattgtttttccccctactggtcttaattcatgttatcttatctctggcctgtctgcttctgttggcatgttggacctgggatttgaaaaactgttagtacaaataatctgagcccaaggtgatgctattttcctcctaagaggattctcatttgcttctgccagatgcccaaaggcactagcaatcttgatcacctctgttcaatttcagggattgagaggattagacctacaatccctgaaacagctcatgtacttccagttcacactaatcttattaggatgcagactttttgagatccaagtcaaaatgaggaaggttaaccagcgcccctccaccacccacgtcttggtagcttccaatgccactggccactgtctgttcctttagcttcaccaggttgactgaattactgcttagcctctcagatgccccctccaggaccattaaacacccctagaagtagagtgtaaacacagggttcatttctcagggcatccattctcccctgtgttttgtccaggtaatacttctctatcttattataaggcccttaagcaaatttaaaaatattttgtaatacttttctagttgttctgagtgagaaggtgtaaccaaattacctaatctgttattagaagtccactcatcttaatttttattatagttcttatatatatagatcttgaaaacattcttcattgtccattggtccattttatttcctgtttgtgagtctattctgctaattagaaatgttcatgtatttgtttttgtggctagctttataattataatttcatataatgcttttaatcttctatttcttcagaaagtatctattaatctcttattttgagaaatgatacaatcagtatgcttctttcttacccccactctaccacttgattcaacctgactgtatttaatttcttaatatttatagtgacactgttaaatgtatttctattatttcttttgtcggtttaaaacagtatttgacatacagctattgaaaacgacagattgggctcggcacggtggctgatacctgtaatcccaacactttaggaggccaaggcaggcggatcacttgaggtcaggagttcgagaacagcctggccaacatgccgaaactctgtctctactaaaaatacaaaaatcagccaggcatggtggtgagcacctgtaatcccagctactcaggagactgaggcaggagaaccacttgaacgtgggaggcggaggtagcagtgagacaagatcatcccattgcaatccagcctgggtgacagagtgagactctgtctcaaaaaaaaaaaaaaaaaaaaaaaaaaaaaaagagaaaagaaaaggacagaatgtaagtaatacatatatggagtaaaagaaaatatattgggaaaaatgcctctttgcagacagccccttctctactgtgctgcctgttgcaaccttgcaacgtattttcataccttctctaataaatctgcctttttttatgtacgacggtcttggtaaattcctttactgcctacgacaccagcctatatagtcacacccgtgacattttctataagagaaacatgaatttaaggacacaaaaagttaaaattaaaattatgcaaaaaagatataccatgcaaacaataaccaaaagaaagccccttctcttattctaatatcaaacaaagtagatattaaggcaaaagcaatatttcaaaccaagaaagatattttataacaataaaagagctaatatatcaggaaagtattaaaaaaaaagccaataacgttgcttcaaaatatttaaagtaaaaattggcagaactgagggcagaaatagacacacccatagttatagtaaaaggattacatttaattggccacttataaaaattagaccttcaaaagtattattttactttaaagcattttcccaatatattgcttttccaaaaactaagttttgaattaatcagttctgttgttaatgctgttttcaagattgttctctatacatttatttttacgtttccaatctttggatttcattggagttatttttgcctttttcttatgatgcaaccaatctggctagtttgattgatttgtctcagtgtgggcttcctatattacagtcactctcatttctaataaatggtaacaaccagtacccatggtgataatagctaacacttacaaactacccactgtgaactattctaggtgctttacatacattaactcaattaattaccatagcacaattttttatgtaagtataattatcaactccattttagagataagggaactgaggcatagaaagtaactaacttactcaaagttacatagctaataagtagcagggttgggattcaacctctgacagtctggcttcagagggtgaggcattaactgctctgatatcaccttaccccttccaatgattcagattctcaaattttcctctctgagcacaatgtcttcacttatacatcccctgatatggtttggctctgtgtcccccacccaaatctcatttcaaactgtaatccccacctgtcgaaggaggtagatgattggattatgggggtttcccccctggtgttctcatgatagtgagtgagctctcatgagatctgatggttttataaggggcccctctccctctgcctctccccctccccgtccccctccccctctgtctctctctcacacacctgccaccatgtaagaagtgcctgcttctccttctgccatgattgtaaatttcctgaggcctccccagtgatgtgtaactgtgcgtcaattaaacctctttcctttataaattactcagtctcaggtatgtctttataaagtaaagacagtaaattggtactgaggtagtgaggtactgctataaaggtacccgaaacgtagaagcaactttggaactgggtaacaggcagaggttgcaacactttggaagcctcagaagaacacaggaagatgtgggaaagtttggaatttcctacatacttgttgaatggttttaactaaaatgttcatagcgatgcggacaatgaagtccaggctgaggtggtctcagatggagatgaggaacttattgagaactggggcaaaggtcactcttgctatgctttagtgaagagactggaggcattttgcccctgccctagagatctgtggaactttgaacttgagagagatgatttagggtatctggtggaagaaatttctaagtggcaaagcattcaggaggatgcagagcattaaagtttggaaaatttgcagcctgaccatgaggtagaaaagaaaagcccattttctggggaggaattcaagctggctgcagaaatttgcataagtaataaggaaccaaatgttaatagccaagacaatggggaaaatgtctccagggcatgtcagagaccttcagagcagctcctcccatcacaggcccagaggcctaggacagaaaaatgattttgtgggcccggcccagggacacccttgctctgtgcagccttgggacttgctgccctgtgtcctagctgctccagctccagccatggctaaaaggggccaaagtacatcgcaggccattgcttcagacggtgcacaccccaagctttccacatggtgttgggtctgtgggtgcacagacaagaaatgaggtttgggaacctccacctcgatttcagaggatgtatggaaacacctggatgtccaggcagaagtctgctgcaggggttgagctctcatggagaacttctgctagggcagcgtggtagggaaatgtggggttggagcccccacacagagttcccactggggcactgccaagtggatctgtgagaagaaggcccccatcctccagaccccaggatggtagatccaccaacagcttgcaccctgtgcctggaaaagctgcaggcattcaatgccaggccgtgaaggagctgcccaaggctgtgggagcctactccttgcatcagtgtgccgcagatataagacatggagtcaaaggagaacattttggagctttaagatttaatgactgccttgctggattttggacttacatggggcctgtagtccctttgttttggccaatttctcccatttggaatgagtgtatttacccaatgcttgtacccccattgtatctaggaagtaactaacttgcttttgattttacaggctcataggcagaaggcacttgccttgtctcagatgagactttggactgtggacttctgaattaattctgaaatgggttaagactttgggggactgttgggaaagcatgattggcttttaactgtgaaaagacgtgagatttaggaggagccaggggcagaacaatatggtttggctctgtgtccccacccaaatctcatctagaattgtaatccccgcgtgtcaagggagggacctgtaacccccacatgtcaagggaggaaagtgattgaatcatgggggaagttttccctatggtgccgtcatggtagtaagtgagctttcacaagatatgatggttttacaaggggctcttgccccttcacatgatctctctctctctccctcctacctgctgccatgtcaggcatgcctgcttctccttctgccataagtttcctgagacctccccagccatgtggaactgtgagtcaattaaatctcttccctttataaattgcccagtctcagggatgtcttcatagcagtgtgagaatcgactggtacaccccactgcaccaaaattgggttttcagccccttcctcaggtataagtctagtaacttccttcaagatcttctcacctcctaacctagcctgaatctgaggctatcttaagttcaaaattaattttctgggtttcttgatcatttggccctctcaaacctcagctctttgtccaaaccgcctttatgtgtattaatcctagccagctaagccccactggagacaatcacaagcctaccaagatgagcctccttacagatgatacctgtcaacctcatgtagatcctccttactctgacaattatttgttttccactgtttactcactttcccatttcccctctgttgacctttctaaacattcgtctctctcattaaaatttctgcctaatcctgcctcctacagacttagcagataaccccaattcctataccctaaggaaaagaacgtctgaattgagctttctaaattcccatttctcctccagaaaacctatctgttgtgtcattttttccttcttttctcccacatttttcaatttcctcccttcctcccatgcttgctctcttttccctctcttccttccttccctccatgaatatttgttgagtatatgcaaagcataggtctaggttctgtggacaccacagtgaatataacagaactcctgctctcctgtagctcacagtctagcagggcagacaactgagaaacaaatcaatgtatatcatctcaggcagagatcagagctttgaaaataaatgaagtaggataaaggagatagagaatcctgggggagagtgctttatttctatatttgatagtcagggaaagcctcctatgagtaagccttgaaggttaggcagccagatttagcaaataaaaagatgggatccagttaaaataaaaaataaatataaaaagtccagttaaatttgaataccaggtaaccaataatttttagtataaatatgtctcatgcaatactgaaaaattactcattgtttatctgcaatttgaatttcactggatgtcctgaattttatctggcaatcctctgaaggaactatggtgataaaccattcatagatccagaggatgaggtttcaggcagagggaacgttttggggatattaattttatgtctgcaattgtgttaggcactgtggatacagaaaatcaatacaatggtgttttgtctcctaactggtcttgctgggtcactcctctctctcctctagtccgtttctacatacagcagttagagtgagcctttgaaaatacaaatcatgtaccttctctgctcaaaacccacaatggcttcctgtctcagagtaaaagctggagtccttaaaatggacttcaaagacctaggtcagtggcactcatatacatccactatctggagttctttaaaacattccacgcctggatcccacttccagattctgattaaacttgcttgtgctgcaggatggaattcaggctttttcagtttcccaggtgattccatactgtactggagtttgagaccctctgcctcacatgacctcatactccttctccctccccagccccagctctgggagctccccaccggctctctccactgcagccccgctggccccacactcttccccaacactcttcagtggtgctgttgcctggaatgctactttcagaatagctacagggcccctccctccacattcatggggtctctgctcaaacgttactttaccagcaaagcctttccagatcttccttgcccttcacgctggtgccccattctctctctttctgcttaattattacccatagttctcaagatgacttttcctgttgtatatttgtgtctttatttatgtctgtctccccacactctagtgtaagccctatggaagcagagtactttgtttagttcactaatttagtgcctatgtacagtgcctggtatataggttgagctcagcaagtataggttcatgaaggagttcagagtctagggggaaatttagacccataaacagttaattgtaatacaacaaggtatatcataattacaaagttttaaacagaattccctagagactagaaagcttttgattcctgattccaccccttcccctccctctaggatgttgtttcccaactatacctttaaacattttgctctccacagcctccatctgcaaacccaatcaagcccttctctctccgacgcccctcaaaagctaccatttagtgagtatgctaggcattgtattaagtacattatggacatcatctcatttaactcacaacaattctggggtagatatcagtattatcccctgatacagtatgaatgtctgtacccacccaaatgtcatattgaaatgtaattcccaatgttggaggtagggcctagtgggaggtaattggatcacgggggcagatttctcacgaatggtttagcactatccccttgatactgtccccatggtagtgagtgagctctgctgagatctggttgtttaaaagtgagtgtcacctccctgctttctggccccctgttctggacatgtgaagtgaatgcaccccctttgacttctgctatgactataggtttcctgaggcctccccgaagccaagcagatgccagcaccacgcttcctgtataacctgcagaaccatacgccacttaaacctcttttctttataaattacccagtctcaggtatttacttatagcaatgtaagagctgactaatatatcctcattttacagatgaagaaactgaggcccagagaagttaggaaacttggtgaaagcaagatgtgtctcacttcaaatcctgcgctcgcaatcactgtgttctttatggtttctacacctggcctctcctttgtcagtcccagcttcatttgacctgcaggctgctctccaggactccttctggctagatatatggctgttcttctcccttcccttcacctcattgtccaagggcccttcagtgtctagaccaatcatgcaagggggtaaggtgggtgaggggagagttgttaactaatctggtaggtcagacatggctcctagactctttcattactccttgagatgctttgctgccaccatgtcctctggtttgaggcaacaccccacaatgccttggtcttcatgtcttcccaacccatgacttgttggctttctccttgacgttctgggcaaccaccaaacatccaaacgtcagagctgatcccaagggagcagagtggaggcttctggctttcttacatatgcatttgataaggggcagctttttttgactttctccttagtgtggattccttttcaacataccagttcctttctgtgtggtgtgaggacctcagatgcgcatatgcccttatcacaacaccaccttctgaggccaccttctttctgaggtgtgttggcagaaaaatcgtgacggtgtaattaatactgatcctgattaatatttggacttttcattttttgcctcatttcaaatcatggtattttggctacatatttgaaactcttgcaaattttattgatcagcttttgaaattggtttggaatttaattttgtttccagttgctttcagtactgcagtagaggctgtggaggtcactgcagacggttctggtatctaccaccaggtttccgtgtctctgttggaggcggaggtattctctggcagtaggtgtctcctaggcctctgtgcagggcaggctgcaagtgcctgggggttaatgcatgggaaccattctcaacctaccagggaaaggaataggtagataagtgccccagcttccttgctgtcagacaattctgagatgtgttccacattatttttagatcgtctccagtgaccaatcgcccacagcactaaccagcttattaatgtattgctggcttttccgccttttctgtttcactcccctctacctcctcagaatgcttccagggatcacttctcaaataaactattggtacccaaatccttgactcagagtctgcttctggaagatcccagactgacacaatatacattttgatttttcctctaaggagcagaaaacaaaattccccaatccaccatcagcaccttctcagttgctacttaaatcaggcaaactaatctggcctgcagacaccttctccttctgctttgactaccaactaaacacctccctgcacacaccaaccttccttttgaccactgaggttctagctgtttttacaaatttccttttataacgcttttgaaagtaaatttgggtctatttgattatattagccacccatttgattcataaagatggataaaatttttggtttgaccagtgcaatctggggatactgttgcctaggtaacggcctgggtgggtgaggaattaaggataataggcctaatgctacatatgaaaagagaacagattgcctggtagaaggaggtgcattagatttctcaagtaacttgagatgccatttagttcactggaagaggccattttctaggcagttagaggagtaaatgactcagtaagagatgctgtttgacagttgggatttctgtaagggaattttctgtcaccttattccaacttcttccagttcaatgtagtcgtaggggaagcaatcatgtacatacacgcacatatatagggaaaatactgagaaagaaagaaaaacataccagtgcctgcccatgtaggtcgttcctccatgtcccattggatagaaaagatttctatacaaaggcacatagatgaaaccttaattctgtctttctgcccaggaatagcagttgaatcaacagtctgcacttctaggaggaaataaagagcatttatgctgtgaattcagctaaatgtgtatatatatcaggatttgttgagcttcctggccctggtggcacaaaagaagcaccatattacttagtgcttcatggctagcttgaaatgcaacgaagatttgtccagccaggctccacacccccaaaaagctcctggctgtgtcatttgctcgtttgcctttaaaggtactaatataacagcaagtaccttacatgggattccatggcactgaaacacagtggaaccggattttgtagaatattgctgtttcccagagccttaaaagcatccctcgaaatctgaggtgttggtgctgcaatctgaagatatcataagcaaacaggatcggggattaaaatttcaaagatagcatctcttaacatctgataagaatgttgatgatcagagcttggataatgttagcatcacttcagggtttttgtatctaaaatgataatgtcattccaaccgtaaatgctcttccctctcccgtctcatcattggtgaccttcttcatcacattcagcctctccattaaccttgcctggagagtaaaccctaaaccctattttggtattttctcctaatgtcttaatttgcatgccattgcttcaaggttttagtatggtgcattgcaaggattattcaggatgatcaccaacaaacatgctggcattataagaaaacggtttggttcaaataaaaaaaaaattccgttgagagaaagaaatctacgcatgtcagcattttattttaaccacttgatggaaatctttaataatgtatttccatcttcttctattccttcaccccagaattctgaatgtggtctaaatgttttggatgatttaggatcatcatgcatcacgcaacgatggttgtgctaagttttcaggccctactgatgtaatcaaggggctttgattctctaaatggccctgccactaccgtatcttttgaatactattatacttgggtttctcttttgaagtttctgtgtcttttctctctattcccctagtcagtgtgcctgtttctgccaattatctccacccccacgccatttcaaacttacagctgttaatcttttttttaatatggcaatgagacaactaagtttgttggagcagcaggtaaagttacaacacatatactcttaaggacctgaggcccctttctatgagtaaagtgtattagctttgtgcatgaacttgacacattttgtttgctcagaaatttgtattgttgtaatttagtgactaggttctgtgtataaattacctaaataggtaattatacaccagaggactgtgaccatattctttgtgtgtgctttttttcccaggatatccctcatagattatttactatgaatttagagaccatgataccatttccttccagtgcttcagtaattggctctcctttgcatttctttctctctcaagcattaatgctcaccaagtcctccacatccggttcactaaatgggaggcttctatggttctgattggatgtttagagggtgtggctgacagagtattgtataccaaggcaggctaatactttgcagatgttttggttgcattggcagatacacttgaaagtgggaatgttatgaactttctggtcaggttttagaacctcatttgccttgagggcccaagacttctttgggatttcttgggcaaggattaggcttattattttgtcgaacaaagaaaaagccaaactccatactcgttcttatgtctatatttctacttctaagtgtctttgttcatttaagtcaagtctatctttagatctgtagaattttatgtaaaaggctttggagttcttcttccccagtgagcatggtttgtagatgatgacacaggagttctgaggttaaatgatccaatcaagttccatcccctagttaattagtgacagtgacaagacagaactgggacccctgattagttttgttatctagtttattttaatttacttagcattttagtcacactgacccttccttgtgaattttaaacgtcttggaggtagaaacatacttgcaaagtgcatactggctttattgtgatgagtgttcttcattagctatggaatggtgagagtgcccacactcactacactgcaaattccagattgatttaatcgaggattgggaacttcacagaagagagggggctgcagctatagaaagaagagcaggtgcaggggaccacagcagagcagcctttgatacccctgatcccgagacacgtttggtcctgctagccttggagtgcttccttttgtgctgtccctgagtcttttataactggctaatgtgaccatccaggaagaatttccaaaaacaacgcatatccttaacaggaaacagtgacaagtatctgagcccttcctggatcttgaatcaaactcaaggtcagcaggctgcatcctcaacatgaagagaaagcagattcagggtccaggccatatagcattgtggtaaagcacatagagttggaggctagactctctgagtttgtttctcatctgccactcagacactgagaaacctggagaaagttatttttaacctttcagcacctcagtttccccatctacaaaatgaagataataatagtatctactaagaaggttgttaggagaactaaacaggtcaatattgtaaagtacttcaaacagtacagaatgacgcttagcataacgtaagggccatataaatgttagctattattatcatatttccatcttgtccagcatctcatttccttaacaggctctactcagggaagatgctcatatttgaataaataattagctttgggaatggatatgtaaataaaagtgcaagttatgaagttgattaatgttttcttccattgtggatatatctccaattttgtttccgaacaaatacataaatcaagtacaataaatatatttctcgattccacttacgtgaggtttctaaaatagtccaactcatagaagcagagagtagaatgcttaataccagggatgggggaagggaaaatggggagttgctgttcaacgtctataaagtctcagtaatacaagatgagtaagttctggagatctgctgtacaacattgtgcctatagttaacaatatgctatcatgcacttaaaaatgttgttaagaggctgtatctcatgtaaaatgctcttaacacacacacatacaaagaaagaaatagcaaagatgtaggagatagtgttggaaagtctgtctccttgatggcattcagataaatgaaaaataaatctgggcagtccaatgtggttgcaaatatatattttagtacacaccatctaataatttactctttttcttttatcagagtatatttgaatgagtcagccattgaatatctacaaagtgttatcattggttaacatgccttttaaactaaaaagtatcacatgtgaatgaacatttgatagcaataagtcggactatttgaaactgggacttccttttctaaaaaaataaaaaaagattattatacttattcctatggtgtaccgatcacttttatttataatatacaggaaataattttagaaggagaaaacggaattacctagtccagaatttctcagtattgaatccatagtggtttatatgtatgctaaagatattggaacagtcttaaaaaacaagcagacttttaaaaattgcaggactgctcagagtctttgttatgataacattttgcctaatatatttgactacttgaaaaaaagtgttacggtgataaatttcctatcctacctagcttttagagattaaaaacaaaactaatcaaggttataggatttataatttccagagtactcttgcatataatatttcattgtatgcttacagcactttactaagatattgtcattagccccattttacaggtaaggattttgaggttcagaatgttgaaatgaattgtcctgaaataaactgccaatgaatctggactgaaatccaggttttcagtccctgaagcccatggaaagttcctcttctccaaccacaggtaaacaattttcaaagaaccctaacatatttccttcataccagaaaactatctatcatgattcaaaggatacctcaggatactgaaaactgttgtgagcatttattattgtggaacattactgcaaaacggttctggccattagaattttctggtagtgtacatgctggataaagggaaactttaccaaggtaaataataatttgtgattagagactagaaacaatgctgattttattatttaaccatcctagtaagttatgagggagaaatgattgtgtaatgtatatgtgcatgtgtgtgtggagttctgcttgtaaacttgatgttagaactgatacaggagatgtacagcagaatgggtcccagaaggaaatcacatgtctgtttaagggaaaacttcaaagtcagtaaatcttgtttttgcttcggaaattgtcaccgtgtacccagtttctgacccacacttagaaatggtctgtaagctgtggctgtgtagatgctttcaaaattcctcctcataagattaccagataaacataatatgatttttgtttctattacaaggtaattggagtcctaatggtcccctttcatcctctccttccctgactgcaataacaaagcttaactttatctcatttgaggctcttaaaaatgcttgctatacctgtatcccttcatatattccagagagagagaaatttaatttttattagctgagccctatgagtcattctgctaactggcaccacaaaccacctccccaccagactggcctttgctgagggctctaaatttagaaactgaatgagattgcctctgggttacataaggaagcgaggaagttatttttagcacgccattatacctagagagccctgtgcttctatctgatttgttaagcacaggctgaaagaaaacgtgattactgattctctccctgttcgggtgcagcatccctcagtaccaaatgacatttccagttttgtttacctgcagtccttcatgtttattttgtctgtgctataaacacactgaaaatcaattgtgttgaaacacgaggtgatattttttactacctccttcatttggggaaaatctccccaatatgtactgtaattttatcctttctctctcgctctctctttcttttaggagtggaaggaaaacgttttggctgctcctattctaaggctgctgtcagagctgatgatggcatatgtctatctagaccagtgaagctttgtttgtgttttctttgccaggcatttgtttttactttcttttgcaaggggactgctgcagctgattgggaaaaataaaagtggcaaggcaaacattaggaggcatgctgtcatctaggcagaacattaatgaatgcagtggtggccagagagagaatctggatagaggcaatgttttgcttgtcagtgtattcctcttgtttcccagcccaacatcaaaagtccgcattagccccttctgattcttctaggttgtattttagcaatcaagcacatctaccttgttggaattttgatacagtgatggcaaatgtcacttattttgatttataattactttttaagagactggatggtcatatggctagttgcctagtaaatctgtctacttagagttacgttttttttttttttttttctgtaatcagtgtaggtagctgagggttttagctagtgtatatgtgccgagcaaggagaaagttgtaagaagtgaatggtgcacatgagcatcagggcattcctagcagaaaaattaaaagtgctcactgaaatagtccaccaagatattgctaaaacattagtattttgcagtggttctgggaggcaaggatctagattgtacaacagtgatccaggcagctcactgtgggtgtcctggttaatgagctggctggagtggggcccccactttctcccagcaggagtgactgggtacccaatcttaacttgctaatcaaatctctattcttgttcataaaattatttttagagacataaatctaatcatgtcatctcatttgttaaaaagcaaattagctataacagtccttaaataatgataactaaatggcaactaaataaaaagcaacttatctgtttctcaatagcacaatttacataaatatggaaatatgtggtataatatataagtcattatatttctcagaaatggtgggggggtgtggagagagagagagagagagaaatcttcaacggaatattacattactaaacataatacttgattcagccaagtcagtgcaatttcttccagtgcgagtatttctgtacctaagcttagcttctcatagaccccatgggccccaggtgctggtgagttggtggtcccaggcaactcctgcaaacagatgggacccaaatccagatagcttggtgcctaggagtatgtttgtggacattttctgtcatatttgctgtaaaatttagagtgaacaggggagttttttctagatgcaaatccatgccttggccctgggatgcctctctgtgtgtctaatgggaaggtgaggcatttatgcccttgcttgttttatgaccatggccttgtaagtttctactttctctatatggcgtgacattgtgggatttaagtcctttaacaaaggaggtgataaccacaaactgacccacctggcacatcaggtgaggagaatcccaattgtccagccagcaagggtccagtaggccaccctggaagtaggagacatccctcctgagagcgaatacaaggtatctggagaggtggtgagcaggatcatttgggatgaaggaggtccactggatgaccatggtgatgtcgatcaccacagcccctgagagggcaggccaggccactcagccctggaatggccagtagtccagtgagtggcttcattctctatcaaaagactactagcatatgatccagcaatcccactgctgggtatgtaccccaaacaaaggaaatcaggatatcaaagagatatctgcacttccatgtttattgcagtactgttcacaatagccaggatttggaagcaacccaagtgtccgtcgatgggtgaatagttaaagaaaatgtggtacatccgcacaatggaatattattcagccataaaaaagaacgagctcctgtcatttgcaacaacatggatggaactggacgtcattatgttaagtgaaataagccaggcacagaaagacaaactccatgttctcacttatctgtgggtactaaaatgaaaaacaattgaactcatggagatagagagtagaatgatggttaccaaaggctgggaagggcagtgtgaagaggggtggggaggaagtagggatggttaatgggtacaaaaaataattataatgaacaaataagatctcgtatttgataacacaacagggtgactatagtcaataataatgtaattgtacatttaaaaataactaaaggagtataactgcgttgtttgtaacacaaaggacaaatacttgagctgatggatgccccatttactttaatgtgattattacatattgtatgcctgtatcaaaatatcccatataacccataaatatatacacctagtatgtacaaacaaaaattaaacattaaaaaaaaagactactaggacttggggtagctggtcatttggaagtccttgagtggtggctcactgtgacagcagaatcctgggtgctgaagggtggcagcaggtgactgaagcagcccaccctcttcctcaagagtcgggaatccctgaatcctaaagacagaggatggaaaggccccatcccaggatactatctgggcagctagggcaccttgaatgtatcacctagcagctgtttgggaaaaacttcagtacagatagaaatggaacattaccaagagagagaagcaggctccctccaggctagcacctcactcttggccagaaaaattcccaaaagcttgactgcttgttttcatctgtaaatctgaatggtggtcggtagggagggtgtaacgcgggaccctctactacaaaataaaatgctagactgagtgtgttggatatatctaataccttgcctcatatcctcttggcccacctaactttctgtggtggcagccagccatatgcaggtggcaagtaacaccatcctaccctggctacactagttatctgatccaagacttcctgtagcctctgtgttctgagggtatgcacaaacccgaagggagttaacccccatgggaaaatccttgaccactaggagatggcagtcagaagataagtattcgtccctagggcagagaactctgaggaacatgctacatggcgctcagggggatctccagaaggattgagctccaatcgtctgcagtatggacagcttactaacgtgccctttagactggcttttcatcctccctgtttcactcttcctagtacccccttttctgttccttgggatcactttccaaattaaacaacctatatgcacgccgtgtcatgacagccttgtctcaggctctgcttttgaggggaataaaaccagaacaaggcaatatgcctacactactgtagaattggatacaagggaacagagcagaacttcggaaattctgaacccagttggagagagactgccatgttgggaagtccctctagtgcaagatttcttaacctaaagcactgacgttttggatgtgataattctttgttgtggggcaatgatctgaccattgtagaacgtttagttgcatctccagcctctactgaccagatgctaatggcactccacccctaagctgtaataatcaagaccatttccaaacactgctaaatgtctttgaggggcaattcactcctggttgagaaccactgctttaagggaacacaaactcatgctgcatgttcaacagattgttcaaatctcagcatgtctttctatgggataatgggaggatgggagtcttatggcttccttttatcctgatgccggcttgtaaatttcccgttcccaataaagcctatccttcataccatggcacattgtggaatatatactgaactctggcacgtgactgacagtggttcggacagtggtttcaacagctgatacgaaagtggtgaccatgaagggatgtgtacgtgtacttttgcaccaacctaatatatatatatatatatacacacatgtgcacacacacacaccttatatgcatatatatacacacataggcacacacacatatatatacatacacacatatacacacatacacacacacacatgcacacacacacacacacacacgcacgcacatttgcatacagcctcaggagatgcacagaccccctgaagaccatgcatggacctagtagagtccacaaatcccaggttaataatgcacgcgtaggtagagttttttttttcccctaagaatacttaataatagacttggatcacaaaaatagtctgtttgttccacttattcaaataagtataaacatctggattttgaatccctggatagtgttccactcaaggaggaggtgctaatctcctttgacagttttaattttaatgccgcttgggaaaacatctttctcccaaaagaaaacacctggcctgccctgaatcacctgtcatcaaaagcctgtctcagtgttaaatcattctcctgcccttccttcctattatcaccataggcttctattatcaccatttctggccttgccaaggaagataactgatttattctgaagtggcttaaaagaatttactttattaaacttttaacaaactattgagaattaagttaaatatttgaaatttggggtccaaagatcgtgatgcgtggaggtgtagggccatgggaggatggacacccaacaacaatctgacatagtgtaaatgtcttcatgagatggttattttttagtttctggctcaagggaaaaaaaagtcacagttttagccattgtggtaataagttataaaagctaacacttattgagcaccatggtagatatgctagttgtccaccaactatttgtgcttttctttccatagagtagtagtgttgccggatagcagctgcccagacagccagtacatttctcagatccctttgcatctagaaaggaccactggccagtggagtggaaattgaattgatttatactacatctgagactaatccttagaagcctctcaccagatcctacactctctttcttcttccatctgacagctagatgtcgacatccaaggtggccttggaagccagtttttgaagaaggcagaagaatatcctttatctttgaacctttaatgactacatggagcagagcatcatcctttcccaccttcaacctctgatcagccttctcatgaatgagaaataaatttctcttgtgtaaagcttctgagactttgggactttgctctgtaagagcaactagtattatttcaactaaatgaagcacttaacatatgctacacactcagtttttttttttttctggttctctggctgaaaacacacaaagttttttgtacgcttatctgttttaattcttataacatccttatgaggtaaatatatatattgttctcaatttatagataggacccaagacatagagaaatgttgcagttttcctaatgtcactcagtaaataaatggctgaacttaaattcaaacccaaggggtaaatctctagaacttctgcttcttggcattctatactactgtcccagtagaagtccagctgccactcaggtttcttaacatcataaggtgagttcacgtgtcattctgttttatattccatatggttataatttttcccctctctgggatgttggaacactaagtgaggattttattttgagacaatgaagggtctcaaagcagatgatacaaattacaaaaaccatctcacaattcaaatgaatgtgatgaagactttaatttctgagtgaaactttaaaaggcgacaaatttttaggagatgaaatggattatatcatctctattgtgacaacttaaatatggttataaattatttgatgttttccccattaagaggcaagctctatgttccatctccttgaatatgagcatgctatgtgactattttgaccaaaagaatatcatggaagtgacactatgacagtttctgggcttaggccagaaaagaatggcaagttccacatcctgtcccttggaatacccactcttagagccctgagctgccaggtaagaagtctggtcacctgtagactgccatactttgagaaacacagccacacaggaaaacttggataataatacactatgtggaaagagagaaagggagattgacaaagaggcagagaccacacagcttcagacatgtgagtaaaaagttatcttggaagcccatcctctggccctcctctcttgataatacatggatcagagacgaactgctctgctgagcctttctggaattcttgacctataaaattgtgaggaaaataaaatctttgtttcgagctgctatgttttgggaaagagtgttatgtagcaattgataactaaaacatccattatgatggctataatttatttaagaccaaactaagcttaggagttgatcagcaaaaggtagaagagctttatctgtacaagatttaaccccagagaaactgaaaagcaagaaatttgatcttacaaaagtgagagattgaatagtcattaatccaatgccagatggtatcctgggagagcatagaaacaagagaaaacatagccccccaaaacctgtggaaacagaagctatattcctagatttctaacacaaaaaggggctggactatgttttgcccaatttagtttgctctccaggaaaagacttaacatatggaaacataaggacgggatgtcattgttacacgttttgtgggtatttcgttaatataggtccactctacttctgttttgtagtgatggttcccccagaggagtttcttactcctaaattcacattttctgccaagaggactttgggattcttgattttttttttaaatttgagattcccgacatctcagaaattgtcttcagacaccataaaactcatcctgtaattaccacattttcactttgaatctttattatcccatttataataaatgtgctaataaaccatttatctgtaagaaatgtaagaaatataaaacttgaatcattcacacaataatacagcctcactggcagtttaaaaggccacaataacaacataaaagggaatattatgccgctattaagaatataagttctctgtgacatgaaatggaaagatctctacacttttcttttttaaagcttcacgatatataccgaatgggtatagtatgctatcttttgtgttaaaatgagaaaattatggtgccatatttctatccacacaaaaatattctggaattatattcaagaaactaataaaagtaattacctatggatctggggggatgaggaagcagactgacttgggacagggtgggagtgagaccttttactttacatgtatatgtaaatacatattacctataggcatatgtgaatacatattacatataggcatatgtaaatgttcaatcataggaatgcattatctttttaaaaataatctgaagtccatagtttacattaggattcactctaagtgttgtacattttatggtttggaacaaatgtataataacatgtatctatcatcagagtatcatatagaatatttttcactgctgtaaaaatcctctgtgctcgccagtttatctcttctcaccccaccccaaccctggcaaccatgagttttttttactgtctccacagttttgccatttccagaatgtcatatagttggaatcatacagtatgtagcattttcagattgatttcacttattaatatgcatttaaagttcctccatgtattttcttggcttgatagctctttttttagtgatgaataatattgcattgtctggatgtaccagtttatgtatctacctactgaaggacttcttggttgctttcaagttttgacaattatgaataaagctgttataaatatctgtgggcaggtgtttgtgtgaacataagttttcagctcctttgggtaaataccaaggagtgcaattgctggattgtatggtaagagtatatctagttttggaggaaactgccaagctgtcttaaaaagtggctgtaccgtttggcattcccactggcaatgaatgagaatttctgttgctccgtatcctcgtcagtatatgatgtcagttttctggattttgtccattctaatgggtaggtagtggtatctcactgttgttgtgcttttttccctgatgatatgtgatgtggaacatcttttcatatgcttacttgccacttgtatatctttggtgaggtgtctgctgagatctttggccccttttttcaggttgttttcttattgttgagttttaagaggttctttgtatattttggataacagtcctttatcaagtatgtcttttgcaaatatttttcctaatctgtggtttttcttctaattctcttgatgttgtcttttacaggacgtaagtttttaattttaatgaagtgcagtgtatcgattctttcatggattgtgcctttggtgttgtatctaaaaagtcactatcatacccaaggtcatctagattttgtcctatattatcttctaggatttgtatagttttgcatgttacattcaggtctatgactcattttgatttaattttcgtgaaagccgtatggtctatacctagattcagttttttgcatgtggatatccagttgttccagcaccgtttgttgaaaaagatgatctttgctccattgtattgactttgcttctttgtcaaagatgagttgactacatttacgtggctctattctgttccattgatctatttgcctattctttcaccaatactacactgtcttaattactatagctctgtagtaagttttgaagttaggtagtatcaatcctccactttgttcttcttcaatactgtgagccctttgcctctccatataaactttagagtcagattgttgatattcacaaaataacttgctggaatttccattggaattgcattacatattgacaaaattgggtcttcctactcatggacatggactatccatttagttctttgatttcttttatcagagtttgatagtttttctcagatagatcttgtacatactctgctagatttatacctaagtactttattttggggtgctaatgtaagtggtattatgttttaatttcaaatcccacttgttcattgctgttatacagaaaagcgattgacttttgtgtattaaccttatgtcctgcaaccttgctttaattgcttattagttccaggattttttttttttttttggtgtggattcttttggattttttacaaagactatcatgtcatttacaaacagagatcatttcatttcttccttcccaatctgtataacttttattccttttcttgtcttattgtgttaactaggactttcagtacaatgttaaaaagagtggtcagaggggacatctttgccatattcctgatcttagcaagaaagcttctagtttctcaccattgagtacgatgttagctgtagatttttttgtagtttttttttttaatcagattgaggaagttctccttcattcctagtttactaagaggttttcttttttttttttaaatgatgaatgggtattgaattttgttaaattctttttctgcatcatttatatgatcatgcaatttttttttcttttttagcctattaatgtaacggattacattaattgctcactttccctcccttcatggattcatatggatgaaaaaaggcatgacaccaagaggcaacataagggcttttttggatcccctcctaattttcactggccatctcccattgttgacatggaagacagctgacatttctcaattaagtgttgtacaaatagaaatttaaactctccgtagctcagcaccctcctctcctgtgcttattgtcttcctaaagctctttttatgcaggagttctagagtctggagctaccattgaagaaaatactgtcacaggcagggggatattttctccctcatagaacgtttctttccagttggcactagtttagaggaccatgagtcacataagctataagaccagctgtgtgagactcagataatgaatttatctgggtgattacttttcaacacattcaacccaatgttccccttcagactacgtagggtgtattaatcagctgtttcctcagtaagtgattgcccaataatgctgcataagaaacaacccctaacctcagtggcttacaataacaagcatctatcccgctcacaggtctgtacactgattggggttcagctggatacagctgagtgactgttcttcaagctgttggttggctagacctggcttcaggttgtggtttgggttcaggtgtactccacatttctcatcatggggaccaggccgaggtggcagtggctactggggcatggtcttctcatggatgaattttggaatgaaagagccaagcccaattacacaaccacatttaagactttgcttgcatcacgtcttctaacatgccattgttcaaaacaagtcacacggtgaagtgcaacatcaaaggggcaaggaaatatagtgtgcccacagtgaggggggaagagaataaatatttgctgaacaataatccaaactatcacatcaactttccctctggacttcaaatggagtaaacaactttctctaccctcctttgtacattttctgtgtgaattgagaactaggtgtttaaaggaacatcttctattgcttgaccccgggaggcccacttttgctctctggaatagaggttttagttctttacatgctggtaagtccctcctcaatctattcttataatgtttgtctactcattaagttttttttaattcctagcttgtctgaatattttttccttcactattccacccattacctcccctttaagtaagaaataaaccataaaccaactagagttgtttatcaagaatctgatacatgcttagccatattcggtatattagatacagaaaagtgttcctgtgagttcttatccttgggaactcataactgagtatctaaattggattacatattgaactctgtgatatggacttggtgtgacagttcacaggtaagagcaatttttcaaggtagagatagttaagacaaaggtggaccttgatgaatgggtagaattttgcatagagggaaaggaggaggagaaggaagggtgttactggagggtgaagcagcataatcaaagacctgggggcagaagtaggcctggagtgggctaagactgctctattatagaatccatgttgtttaaggtttcagatttcatacttcgaaatccccaatccagagggaagacaaatggaagaaggcaaaggcatggcttagatcatgaacgggctctagtaaatatgactttatcgtccacttcttaactgccagggtgctgaccaccaggcagtgaagcctgcaccagggcagctctcagtcacatgtgcctctggagacaacattaaagtcacttgataataatagtactcattcccataggttcccagtgccactgccgtgtttcactctccagaaaccctttcactgtctaggacccagaaatcatctttgactcctagatccctgatccatgctgtctcctgggggctactgatcactacaggaccgggcaacctctttccaaagtccccttctaggtgaaaaatattaatacacactttagaaaataagtaatgtcttgtcaggtagaactttactgaggagacactttagggttataagctgaagacgagagtactctattggggttggagttgaatcttagacatacaagatagccatatgaccttgaggaggttaattcagctttcttgggctcactatcctcatatgtaaaacgagggagttgtgatatatctgtggtttttatgcctggctgctcatcagggtcattgggcaagcttaaaaaagatctcaacgcccaagccccatccagatcaattcaatcacaatgtctgggggtgggacttggagaatcagtactcaaaacagaacaaaacaaaataataacaggggattcaaatagggagccattgtttttagtgctctttaaaacttctgctacctttaaggtttgataattccataggatagctataattataataatatatagctgttattattattggtggacattcagtgagtattatatgctaccttactaaacattttacatgaattatcccatttctcacaaccaccccgtgacaaaagtaccagtcttattccatttttcaggtgcagaaactgagtcacagagaggttgaagttatttctccaaagattacattgccagaaagggaaggttttaggttcaaacttggaagtcatctatctgactcaagatctttgatagtttgacaaactatatataaaaattataaaaataaccccataggagataaagatgaggccagatatttcgtagtggtggggacatgtgtagtgagggaagtgctaagtcaagttggaagggtatggtaagaccaacctcacttgttcccctgattcatatccaatattttgagtacttttatattgagccattaaattacgcccgaggacatgtgcttcgtgtggtaagttcctgctttgctatattttctaacctaaaagaactggtaaaagactcaacatggaatgtgacacagatggtctctactaagggatatttctaccaatgaaacaggcttgccagttagtttccaaggctctgatttgctgataattcacactctccccttttggcttggttccctagcccatctctcagtgcctgcatatttaaagctgtccctgtcagaagggaaattgtaggtagaagaactccacttcctggtaatctgatggtcattaaaacatggtcattgaccaaaacccttaaggcacagagctcttcagttggcttatgaacacacttttgagaggattaactgcaaagcgtgtttaatggagggcaaatcagtcagtcacaggcaacacaaatggatgcaagttttacattctggaaagctttcttgggaggaaatgcctgtcatactatgcaacagaggttgttcattgtcattcaacatgggaaatgccacaatgcctacatttgggcatttagctcttgtggagcagatttctgaagacacaaagtggtgagaagaaaacactgtaaattaagctgtcaagtccatgtgcttagcttaacgtaaatacgcatatactctgtcattaaaagctcagtgatgctcttgaccaccagaggaggaggaggagggaggaggagaggagggaggaggaggaggaggaggaggaggaggaggaggaggaggcatttttctgtgagtttctaacttaggtttcgtcttttccagagtttgctttttcaatcgtaacatacttttcctgcaattttcaggattctgtagccagcttacttgcatgcatccattcatttatgcctccgtgcatgcatccattcatttctgtattggttctttcagcaagtatttgttgtaatgccaactaagtgccaaatctcttagtcatgtttccgtgtgactgggccaacagttttcctgaagcttggatagtattttccacctaaattttcttccaaagatgaataactgtatatttgttacacgataattatcaaatgtgtgtctctttattaagcttgtggtatacaacagacacaacatttaaaaaggctatttaatttgcaacttgtaaggtaaaccagcctaagttaaaaggctccctttgttccccatttgataactatggtaatgcctggtcttcctctctcttaacttttacatctttagagaaggaaacctttggctcctttttctcatctgcttgccttggtgctgaactccctgagttcatcctggctttactgttctgtgactttgctttgatttaaagtgctcatagcttcttcattcacaacaagactgcagcttctctctcagtttctgcctccatcagctgccagaggaggagtcctgtgcgggatggggaggggagagaatgacacagcatctcctcctcatttcctttccttgcatccacttctccctctccctctcctcccacctctcctccctcttctttctccctccctctcgcacctttcctccccctccttcttcctcctctgtctttcttctttcttgcttatttttctactaggcagaaaaataagaagaggaggaaaagtatctcacacaaggtgttttagatggatagagtaattttctcattccttcccacacccttctctctttctcttctaaaagaataaatgactttatttcttttagctcacccacctcaatccctttcatcttgatttacctgttggggtggaagaagcagagctggatatagcttcactaacgggtaatacttttcttggtagttctagcaagaggttaccaacacaaaaatttataacctcaataatagagttattcagaagcagttttttttacagaccctgtatgagtcacacagagcaaaaacacttcgctgacatttaaacgatattttaaagcaagatttaaactgttttccttacactcattatcaatgttaggatattttctcagtactattgcagaatttgtgctgatctatccacacagttgcaactgcgttccccttgagaccaaggatacattctgacaaggtggtaaagatagaagctaagaggaccacttaaaaatcacttaaaacttgtagatttttaactgattcagtcaaacagctatattgatactatttggtcacttgcttaccatgaaaatatccctgaacaacttggatttataatgcatgatttaataggtcagcgctcaaaagaaaataatccagggttgtaaacaatattttgactgtcaactaaatttaaatatatccattactggaatcttattcaatggttttaaacacagatatatattttaatttaaagtagtacattttaaaatatgaaatttcctttatggtcaaatatttaaatccttgtaaaatttaaaatattaccactgaatttgaataatcatcttaaacctttgggccttttgattttccctgagagaattaaaaacgtgttttaaagaaataggtagaaatgctatgattaaggtactacattcatttgggtcacgattcttggtacagagtggttgtttattaacattatttttattttaaaaaaacccagtaaaattattgatttgttttggggaaaagtatttctaagaaatctttagctttctgttcaacttgataactctgtccatgaaaatggtgtgtgctgtggaggggaagtctttcaacaccaaaagccacaaattccccagaatttgcagtgctctagcacaaaggagggagtaaaaaaggagcatttgaaactgtcaaaatgtaaatgacacatttaaggtacattcatctggcacagtaacaccttacaatttttttttatcacacctcacatattcagtttccatcattttcaaaacgtgacattttaatataggattttatgactttgagattttgcccatttatagacacctatcttgatactgtacaataaacttctgtcttcttttcctggactagatttgaagcctgggttaagtttgtgttaaggttgccccttccctggctgccaagacgaccaaagagaggcccttgggattctcttcttggcctgcacactagaggtgctccatccaccttccatctcgccctcctcaccacaacgcgccaaagagaccagtccaaagaagaaagctgtgaataaaactgctcttccatttcctcctcaggaccaaacccgtgatatctgatatccttaagttaccaccaaataggtaatctgccgaggtcccccttactgctttttacccataaagcgtttgtttgtctcctatgttgacgcagctcccaaaaacttctttattccgcaagccccttcactctgcccactggaaaaaaacctcttcctatgaacatctcctttaccttcctgatctaacttaggatttactcaaccttggcactactgacattctgggtcggatcatttgttgtgggctgacctgtgtgttgtgggatatttagcagtatccctggtctctacctactagaatccactagagcacccccagactcccaccagctgtgacagcccaaactgcttccagacattgccaaatgtcttctgacccagggggaagggggtatcacccccagctgagaaccactgatttaaccactgttgggattgtgtccttcttgctctgccccttccccctcaaaaaactaaagctcctttaaacatatgccaccatcctactaaccttttgttctactagtggccttttgttatatctactgagctcctggtcacctcttttcttttgatggagattttagcccatggctctgtctctccgtccctccctctcaaatattactctgctgattgctgtcctgtaactttcatatccaaaaagatctactaaaacctctggcctctaagttacttgatcctcctgatccaagttaaacccaaatatcggcccattttacatatgaggagcagaacgtcattggaaaaaaaaaaaaaaacatgcaacccttctattggcctcacctcaaattgacgactggaaatttcaccttacttgactatcctataatattcctggagtcagtttgctctccccctctctctgagactatttcatacctctttttttctcaaaaactccagtactgcctcttctcttgctcttcttaacgactttgtttcttaattcattgagaaaaatagaagtactgagaagagggctattgtattctactaccactaacttgactaacttacttgtaggcatccgcaactttgtattttttcccttccttcctgtcacaatgattctgttcccactcctctctagggtcaccctgtgcccttgcatatctcccttcatctgttttcaatgacccaacgaccttgtccctttacttttcccctttgcttgcgcatcattcatacacccctctctaccatcaacatatacacacgctgtactatcttccatcgaaacaaccacaacctgatctctacatattggcatgactcaatcctatgctttttttcccctctcctctcctcttctcccttcccctctcgtcctctttttgccttctctatcaatatttactctctaaatggtctaaatgagttctgcagcctttaataaaatttatatgctaatgattgcaattgatacctctactttttatttttagctccaagtttatatatccagctgccatttaattggatgcctcaccagcactttcaacttcacatgtccaaatgtgaacttctgattaccccctaaaacctttacttttctagtgttaacacttcctgtaacttgaaaaagatgctctggctgaaaatccagaagtcatgttgattgtgtcttctcttcttcccaccccatatccctcatcaagtcttgtcagctctaccttcaaaacaagtcacaaatttgaactccatccactattatttcctagtctaagccaccattatctcccgggctaccacagtaagtctcctaactggtttctctgcttccacttttactcccctagagaatcttcttcacacatctgatacagtactcttttaaaacttgtaaatcagattttgtcacttctctgctcaaaattgttcaccagagttctatcacatttggtataaaagtccatgtcctactgtgtcctgggcagatctggactctacctgtgatggttaattttatgtgtcaactcagctgatacacacacacaccacacacacacgcacacaagaatcatgtgtcatttaataagaaggttacattctgagaaatgtattgttagacaatttcatcattgtccatacatcttagggcgtacttacgctaacctagatggtacagcctactatacaactaggctatatggtctaacttgttgctcctaggctacaaacctgtacagcatgcgactgtactgaacactatcatagcacactggcaagtatttgcataccaaaacctatctaaacacggaaacatatctaaacatacctgcacagtagaaatacagtattgtaatcttatgggaccactttcatatatttagtccgtcattgactgaaacgttgttatgcagcacgtgactctatctatctatctgtctgtctgtctgtctgtctgtctgtctatctacctacctacctacctacctatctatctcccattggttctgtttctgtgcaaaccctgactaattcactaccaagtctcatttttgcttattgctctcctcccccctcactttgccctggccacactggccttcttgctgtttatcaagcacacatggctcctttcagctccttggtctttgctcttgctgataccccatcgcctgtgctttggacatgtttggccccctcaccagccactgtgcacgtgacatgaatggaagcaagcacggcatcagttatcatgccagtcaaagaaatgtttgtgtccattgaacttgctttactgataattagatcacgagggcaccttgaaaaatacaacttataagtcaccagccattgctagagattttataattcaagtggctgctacaggaccctgcacctgacagaatctcaatgcaacacctcttgggacattttgagaactctgcctgtgcttttgtggcacaaatcaatgactaatctcaaaagagactttgtaatcccgtccgtcaccaattaaataatgcctttcagaatcctacctcatttgacaacacttcttttttgactctgtctgggtcttctgcttgggaagacttggggagacttactgaactcactttggcatgacacgattttcctttgtctggtgagcaatacattcagctttggtttttcagctctgctgctccggttatttcaatatgacagtaccttaatgatttcattttcttcccctttactgttttaggccttcaaaacatttttttaggagtttcagtatttactggttggtctctttgttttcctgagtccctttgtggaaacatggtaaattctcttctgagaaaggaaggattttactgacctggatttagggacaatcccccaactgttttaggtagtttgctctgaaatattattatataaaatttcattcctgaaaccccatcaaatctgaacccttttcgggcattcctgaactctcccctcccccaccaaaaaaccccaaatcccctaaactttaattactatagctatttattttggtccctctctgtgggtgagatttacattaattagagtataatgaagcctgccctttcaaacaaatggattcctttgtttgcgctcatttgggcaaaccaactgcactgtgtgtgatttcgcaaaaggaaggcactgaaaacagctcatacgaaaccagacccccagacctaaccttccccatccttcccaagatacctgcagcgttacacacttgagatttgtgaagagacctgtataaatatgtttttggtcttgttgttttcctacctgcagaagagacacattttctcagaaaacatttccttctctgcggctttctggttagtattcaggccagcacctctgttatcagacggtggcaacaaagcttttccgcctgaatcttctgcgaggtggcgggggaatggattgcacagtaatgagctgtttttgcaggcttccttcgggagccttttcttatatcccttggcaagaggagctaattcaaaacagctaacccaacccttgggcatctaaaattcacagaaattcagccgacttgacaggaagagggtctccctgaaaatcggtactgtaaatcagagctttgttctctgagggaaggggtggctagaggttttctggcacctctcgtataaccttatataagacttttatccctattgctgttttaaagccaactgaagatggtagggtgcgtgctgggagctgcttttctttcctgattatgctgtttcatcctctacgcaacatgaactgagagtctcaaagcgtttcttcctggagaggcaatcacagacttttacttttcatgaacttgaccagatagacttaatcttcttgagggcagggccagcgatttttatttttatatctccagtagctaacacagaggccggcacttagtagaccctcagtgtatactcggcggatgtcggatggctgatggggctagcagtggctgtgctgattctgtttacgtagcaagcattgctgctgccttgctgatgttggtgctcaggtgttacctcggcatgtgctcccatttcttttggctccagcctgcaattgcttttctctcctgtctccagttgttagttctccttctttccatcaaaatatgatgacttcccatccttatagacttctctgtctccaacctaagtaatctgctacacacacacacacacacacatacacacacagacacacatctcctcattcttttgtaggttacttttttgtaggttctaatttccttctcctccaccctcacaccacatcttccccttcaccctcaagggtttccccattctttcaacccaaaatgatcctcattcatcccaggttctgctttgatttccaccttttcttagtccccatcctatgcttttgatgggttttaccccttcatcctctggcaacttccttttatttacatatttcttaacttgctgaaggttggaatcgaaaaggggtggtctttaccttttagatttatattgctaaccagtgaaatacgccaacaatggtgctttaatgggtacaatggtagaaattgcatatgttccctttgaatatgtgggataattattaagagggctagctgaaaaacatcatagtattttgtttgatttaaactactggtctcaactagggacaattttgctgccaaggggacatttggcaatgtgtagagacatttttagttgtcacaactgggggctaggagcagggatacagaaggatgctactggcatctagtgggtagaggccagggatgctactaaacatcctaaggtacacaggacagcctccactacaaaggctttttggggccaatatgtcaatagtgtccgggttgataaaccttggcttataccttctcttcctttctcgggacctttctgccctgtctcttgatgccctgggtcctcgcaacctaatcgtgtcactgtgtctcgtggccctaattgctgtgtttgcccactgcctagagagcaccccatgcctggttttaacctccacagtgaaagctaaccatgaacattcttcagtttgtggaatcctggctagtgggagcaggaagggcctttacaagcttttataatctgccttctgactcttcagagtaaagagaagtgactttgctaagatcacacagctacccccaggctggtctgggggctatggccctggtggcccttttcccagccctcttctgtttatactcactgcttttggtcaaaaagggaaatacaagctaacagcttggacaagggcaagaatcagattgactggtctcgtccaaacagggatgtaattgtgcacttctcagtttgctgggttgctatgaaaacacgtttttcagaatttcatcctttggggctttctcaagggtcactgctggctgcaagttatggccgatgtaccttactgtcctcttagaggggatgcggtgacttgaccaggtaaaacacaattctaagcaggtcattagaaatgaaaatttggggaaggcagaactgccacttctctttatctcaggccatgtagtcagctgtgcactaggtcgagaagtacctgaatctggggtggaaaggagcgtaaacccaaatcttctgcaataaagagccacaatttgagacgattacaaggcaaactggggcaacttccgtgtattctctccttcacctctccccaaacaaccacattttatcagtgagccaaagtgtttttggaggagagggagaagggctggactaatgtttttccaagtaaggtcctttgacctagaggcctcagaatggcttgggataggtgtaaaaatgcatattcccagcccttcctagatcgacatttactagttctgagcggggggaggcaaacactgaaagtattattaagctgccagggcatccttctgtagttgtaagtttaagaaccactgacccagactcttgaataataaagctttttctccctgaaacaattccacaaagtcagaagcttttggacaatgcgtgaatctcagagagaaaacctgctactaaaaaagaaaaacaaaaaaacctggctcttttggtcagatattatggtcataaggtggctgagttggcttggagctttgaagatgtaaaggccacaaagcatcaggctttgctccttttaaagttttgaaagagttggaactgaccttcttttgctctcttggcacctttggacaccctttgaggagacctgtgagtaaagagaaagttttccttgggggctgcttattacctacctctccaagggccctgaaggtgcctgctcactgatctaccttgaatagatatctacatgttttaattaagaatactcacaggcgttgaccacgttcctcatttcaacagtaatgctccttggtttttttactttcccctaagcatgaatcactttccaggggcgatgactcttcatctatgcagctagccacatttcctgggttggcgcttctgtttatttacttgtattttgttggaccaagttttaaacacagccctcctccttttcctctttccaaaacccttagccacttgcagaatggaagctgtcatgctcttttgttaccccactatccaataagcacaacgcttccctaagcatagaccatgttcccttttcctttcagaaagagatgcagaacacaaattctgctgctttgtgcatataagctgtgtaattatctgaccttaggtgatcgttgctttattttttaaattttggagcggagagaaaagtgaagggtgacagtacccaactgagtcctacaaactcctctaaaacaaatttccaaattttgagatcaatcagatccactagctagtcccttattctctgctgtttgtctgcttccttaccccaggacctttgcacttgctcttcccagcttcctatgctcttcatcagatattcactgggctagccctgctcatttgcttcctgcagctctctgcccaaatgttccttcttcatggaggccttctctaaccatccatcccatggtgctccctcttctcctttccctgctttagttctccccacacatgacaaattccgtacagttctctgtgtgcatttcccccaccataaggcaaattccctgagggcagggtcttgtctgttcaatgctgtagtctcagcaccgacaccagtgcctggcatatagtagacactcaagcagtactggatgtgtgaatgaatgaataaacggatgtagaaatgaggcccaaacgactctcttctttgtatataaattcttcccagaacgaacatgcatgtaaggagagaagtcatgagctacaggagtctgataaagatgggccttccacctacctctaagcctgtgctgatggtttctcttcactagcaactgctgtgaccagaaaccatgggaggcttcaaacaaataataacagagaagaatcctttcactttcattggtagaaaacttcagatcaagcaggcatagcagacgctgtctgtttctgcctactgaaccaatatttgaatctcaggattcactatcaaacaaggaagattgggcaagatataaaactaaacacatgtattcttggcctccattattaacattatttcctgcagaatatgccacactcaaatgcatgcatctttttgataacgccacttttccacacacggcaactaaagaacaggattacatgtgcgtgtatttataatatatgaaaatatatatacggtacagggacaaatcattccttattgtgggtgttattgtacatttggaatgttcagcagcacccctggcatctacccactagaagccactaatatcttcctcttagttatgacaacccaaactgtctccagacactgccaaatatccttcgggggatgggtcaaaatcacccccagctgaaaatcactgagttaaacgaagaagacagactctcaggacttctgagtcagtaggcctgggatggggcctgggaatatgtgctttaaaacagttcccccagttaaatgtgataatctgcttgagttgagaacaactgcccaatttattctccttggtgatgacagcatgttcctcattctaaggtcctggcaaggatccagttttcaactaactgaaagtggaatgtcagaaaaatatacatccaagaaaaaaatagaggaaaggaaggtattgctatttcccttccacttttccctctccgtgaagtgagagacactgactctgacacaaactaaattgtcaagtgacaaaatcggaagcagtgttgtctcacacatgaaacgaagaaataaatagaaatggaagtgtgtgcttttaacagtccgtagacacccgggcactctgactgataccatgaggagacccgggacttttgctcagtgtcatagtgatggagtttagagcagtccctgacaaagcagataatcaacagtccatggagttaagaatctaaaaggaaaacggcaactcagaagacgtggctctaacatttgacctcttagccattaattttgatgtggctgtttttaaggccttctttccattcctgcagctctctaaatcgtgacctggcacgcagtgccacttattttttgcctccaaagtggataatcagagatagcattatggagatggagagaccacatacatctacagcatccttgtgtataacgcatctctttttttctctctctgtcttttcttttcttgtacacatgtggatactatttacatttaggttgaaccataggaaactgccatttttggacatttaaaaaaatgatagaatattgacattttatgtagataatcttaatctttcctatgtctccttcttcccctgaccccctttctctctctgtctctctctctctatgtctcttcatggctctatcctctattttcctgcctttgcaagcacatgtgtactacccagaataccagctgtgaaggtcaatagatgttactgggaaaaattaagaaaaagaagaggtttccaaatttcaataactgttaatttgaaaacccactgatgcacttcatatatctggaggggaggtcctctggtccagcatagccaaagacgtgtgaaattcttgatcctaccaaatggaacggtcctgaagagaacgttaatgtgtttgtgtcaccattcccgcctttgcatagtattgcttttttctttcttattgagctctcagattccaaggaatttctccaggtgtggggatgtagtactagaggaattaagactctgtggggcaaaaatctctatatatgtactgaccaataaacaaagccagacaaacaagctatgttgtactgcctggtatacagtttcctgtcaaagcttactttccgggttagagctcaggcttttgcagcatctttgtgagcttctataagtggaccttgttgactgtcctcactctgcttgccaaccccacttctgtctcctggatcacaaatgggatctgtcaccttctcatggatgttacacttcaagtcacaattcctttgttcctctgtgcatcacatgcttactttctcttcatcccttatacacatgcatgtgtgcattcacacatggttcacatagccacattcttagtaatttacatgtcaaatattatgttttcctgttgtgatttggacaatacaggaaagcatagagaagaaaataataattgctcctactccaaaataaacactggtaacattttagttcatgttctcaggttttaatgcatatatgttacattggggtcataccgtatgcaatattacaacatctattcacttaatcttcagagcattttctcatttactattatttcaaaggatgctttttaatatatgcatagtattacttttatatggtgtgtctgctcttgtgttattaatcatttatttttaatagtttgtaatttattaaatatgatgcattagtggactttgttgtatataccatttattatacccttcactattttattaaaataaatttatggaaattgtattactgggttagaagttatgacctttgtcaaagctcttgatatatatttccaatttacatcccaaaaagtttgtatcaatttacatttttaccatcagcataaagaggcccttgtttctctgtatttttcccactttgattgggagaatatatgttatttaaatttgcacattgttgatttctacgactggactctcatattacttgccctttgtatttctttgtgaattgtccatgtctggactttatcttaaaggcaaagggaagacactaaacatttttaactcggggagtaactagattagtattttcaaaagctcattttgataatagtaaagagaatcgatcagattacaaacagggaaataagtcaggagactggtagtgatcttggtaagagatgatggcgacctgccctagagtgatagtaatgggactggaggaaactgaatggttcaaaagatatccaggaggtagaatatatgggattttttagacataggtcatcagggtgaggtactggaccacagtttctcaacgctggcactattgatatttgaggctggatcattctttgttgtaagggaacgtcctgtgccgtgtaggatgtttagcaacatccctagcttccgcctgctagatgcaaatatcacctctttccccagggtgacaaccaaaactttctctagacatcgacaaatgtttctggatgccaaaatgggctctggctgagaactactggaccagtcaatgatgatttccaagatgtgggcttgggtaacccagaaagggaacatggagaggggagcagatttcagtggagaggaaagcggtgattcacatacagttttggacatgttgattttgaattaattgtaggaaagacagtagtaggcaattataatagtatgggctctgaagatctggcctggtgatagcttctgagcctttggcatacagatgatgatcaatgggaatgagtaaagtgagaagggaactgggcttagggtagaaagaacatggaaggttctcaacatttaagaaagaagaaaaatatatcaagggaactcataaggggttatcagagaggcaggtggaaaactagaagagtgaggtgtcatggagagcaaggtaagagacgtagaagtagcagaagcctcttattgtgtcacgtgctgcgagaagtcaattacaataaggaattcactggagctagtgggcaggaaactcttaatcatcttggcaacagccatttcaattgagtattggggtaggaagccagactgaagttggtcaagtggtctctgggaggtcaagaagtaaaagcagagagatgaactattctttaggaagatttgttgacaaaattttctattcagtagctagagaactaagtggggctgagggaagatttgttaattttttttttttttttttttttttttttttttttttttgagatggagtcttgctctgtcgcccaggctggagtgcagtggtgcgatctcggctcactgcaagctccacctcccgagttcatgccattctcctgcctcagcctccctagtagctgggactacaggcacccaccaccacgcccggctaattttttatatttttagtagagacggggtttcactgtgttagccaggatggtgttaattttaatttttaaaattaaacttgtaattttgacataatggtggtagattcacatgtagttttaagaaataatactgagagatccatgtaccctgtactcaatttctcccaatgataacagctttcaaaactatagtagaaatatcagaaccaggatattgacattgatataatccaccaaacttattcaaaacttcccaaattaacctgtacttgtgtgtgtgtgtgtgtgtgtgtgtgtgtgtgtgtgtatactctatttagttctatgtagttttatcatgtgtagagttgggtatccaccaccagtcaagatacaaaggccaggcgcggtggctcaagcctgtaatcccagcactttgggaggctgaggcgggcggatcacaagatcaagacattgagaccatcctggccaacatggtgaaaccccatctctactgaaaatatgaaaattagctgggtgtggtggcacatgcctgtagtcccagctactcaggaggctgaggcaggagaatcgcttgaacccgggaggcggaggttgcagtaagccgagatcgtgccactgcactccagccagggcgacagagtgagactctgtctcaaaaaacaacaaagaacaacaacaacaaaaaacatttacctcatattgccccttataaccacatgtgcctccctcccacactcccactccaaccttaacccctagcaaacactgctgttctctataattccatcatttaaaatgttatataaatggaatcatagaatacatagcctcatggaatgggctttttacactcaccaaagttcctggagattcacccaagttattgtttgtatcaatagttcattcctttttattactgaatagtagtccatggtatagatgtattatagtttgttaaaacattcaccccattgaagaacatccaggttgtttccagttgctataaacactagctcacagggttttgtgtttgcacacgttttcctttatctggggtaaatgcccaagagtgcaattgctgggccatatagtatttgcactttcagttttatgagaaactgccaaaatgttttctagagtggctgtaccattttacgttctcactagcagtgtaggagtgattcagtttctctgcatcttcatcaggatttgatgtagtctcttttttttttttttttagtcattctgagagatacatagtaatattacattgcggtttttatttgcatttttctaatgactaacgatgttgaacatctttcctatgattacctgccatcttcagtgaaacagctgtgtatgtcttttgcccattttctttttttttctgttgacttttgagagttctggattctatatacttgccctcgagagttctgtattctatatacttcttggatatgttatttgcaagtattttacctcagcagcctatagcttttcttttcacaggttcttcgacgagtgaaagttttaatttcaatgaggttcaggttatcactttttttcttttatgactcatcattttgtttttgttatcattgtgtttttcagacagagacttgctctgtctccaggctggagtgcagtggcatgatcagagctcaccgcactccagccaaaatgcactcaaattccaaaatcatgggctcaagtgatcctcctgcctcagcctcctgagtagctagttccacaggtgggtgccatcacacctggctaattttttgtttgttggttttttgtagagacagggtctcactatgttgcccaggctgttctcgaactcctgggctcaagtgatcctcatgccttggcctcccaaagtgctaggattataggcgtgagccaccgtgcccagcctggatcatgcttttggcatcaattataataattcttcactctagccctaggtctattttatcctatatactttgtaaaagtttttatagttttatgttttatacttaactccatgagccatttagttaatttttgtataatatataaagtttaggtaaaagctttttagaaaaacctataaatgtccaattgcttcagtacagtttattaaaaagtatctttaattttttttaagatgtaaaagatttgaggatatataaaggctgatggaaagtagctattggaaaagcatgaggtcaagggcagacaaatccaggagtaatagtggcacaggtccttgagaaggtgagagggaatgaggtccagtttcatcactttaggtataatgtgtgacaagtgcaaagaagaggaagagtttcattgtcatattttcgtcttgtcagaatcatttgggattatggggattatagtcggaattgcaattttgagaaactcacaatatatttgattcatctttccttctcgaatctcatactatagaatcatgtcaatcttttactcaaatctcataggggtcaataaattcaatcccatggttattaatttagtatatacttcatgttcaatatgtagtaagtgacatggggagttgccacatagtacatgattctgctcttgaggtgtttataatcaagttgagaaagctgaaagcagttaaagaaatcaaagaaaatgtataaatatgttgaagtgctaaaaacaggtccccagtttcttatccaaaacatttagagccagatgaccttcaggattgagaattttttccattttagagaagtaatatggtttgaaaactgtgtaatatgaatcaatgccagtgggacaaggccacagctcccaataatcaaactctatatatattaaaatacatataaaataaaatctaaatataataaacgaagactgtaaatacaataggtttgctgccaaattaatttgaactgaacttaagaggaaaaacaaaagttctgtttttatgagatgtttgggtttcaggattgtgggaaggcatcgtggacttttttcctgggtattaactgatacagggaaaggaaatgagtatttatggtataggtagaaacttcccatttgttttcagccatagaatctgagactcaaaacaagtagcaactcagcatcatctggaaacttgtaggaaatgcaaatatcagggtctaccccagacctacttgagtgaaaaatctatgggttgggttccagtaacctgtgttttaacagtgaattctgatgcacactaacaatttttttattgtgtatatataaggtatacagtatgatgcttcgtcatatatatgcatagtgagatagtgactatagtaaagcaaattcatatatccatcctctcgcgtagctacccttttctgctgagaaccatttatataacaagtaggggacggagaaccaggagtcaaattcaggtatttctgactcaaaactgaatgggtttttgatgctgtttcccttgctctcaaagtagaatgaagcaagagattgatgtaagctcagatgataatggtgactttaaagaaggtatgttgaaatatacttcactttaatctaatagataagaacaaaataattttgtaatagacactcctagaaaactattctgtctcttaattatatatacttcactttaatctaatagataagaacaaaataatttttataatatacacccctagaaaattagtctgtcttatttatagcaggaaaaaatttgcattgtaaagtccctgttttatttcctccatgttaacatctagaagatggtacaatttattttgctatttctctaagatgaaggtagtaatttagcttaattgtgaaaattaagagttagaagctgtggaaggaaaagaggttctcaaatattcctaagatggttattgatctattatttggtatctttgatttgtatcaaagatatgtattttcctgataacttcacatgccttgctttctactttagcataattcttagtgtacatgttgacaaatttaagaaaaaaatccaattgaaaaccattacaatatccttttgccagtaaacaatggttatttgtgtggttccagctctactgggaaggcaagagtccatatcaattaggagactacaggtttttacttaaaaggtaagtaaagacccagaggaaagggggaaattgaggacactgatcattttgcttcttattcactgtcaaacaggatgatttagttctgaaagtgagcaggtagccatcaatatggatgtgcttagaatgagacctagcaaaatacaaacctaatagtcccttaggatatgtcccaataactcagtgtcatattgatctccttcaaaaaggaatactgtgtaggaaaataaatcactgtagaaacaaaatggtaagaaatggtacaagactcacactgcctttgaattctctttttaccatggtgagtaaaactttgttctaagggatgaaatgaatataatccagtaacttctaatagcaattaatcatatcagtttagggcagctgttgcagttatcttctgctgcataacaaatcacctcaacacttagtgccttaaaacaataacaacaataattatgctcacaaatctgcaatttgggcagggctcagtgggacagcatgtcttaactctactcagtgactgttgagactgcttgaaggctgtgagccagaattatctgaaggcgtgagcactcacaggtctggctgttgcatcagatttttttttttttttttgacacagggtcttgctctgtcacccaggctggagggcggtgttgcgatcatagctcactgcaacctctgcctcccaggctcaagcgatcctgcagtctcagcctcctgagtagctgggaccacaggtgtgtgccaccacacctggctaattttctgtattttttgtagagacagggtttcatcacgttgcccaggctggtctcgaactcctgagctcatgtgatccacccacctcggcctcccaaagtgctgggattacaggtgtgagccaccacaccaggcttgggtcagatattagttggcgttttcagttgaaacatgtacatgtgatttcttcctgtgacctgtgattcacaaaatcacgactgggttctaagggtaagtatccacagagaggcagagagagccaggtagaagctggatcaccttttataacctagatctggaagtcatgcagtgtctgatctatccattgaagttgtcataaagtcttgcccaggtttaaagggagaggaaatagagcacacttcttgatagggcagtgacaaggttctgagaagagcaaatggggctattgttggaaaatgcagtcagccacaggagcttaagaattatacctctgattggccgggtacggtggctcacgcctgtaatcccagcactttgggaggccgaggcgggcggatcaccaggtcaggagatcaagaccatcctggctaacacggtgaaaccccgtctctactaaaaatacacaaaattagccgggtgtggtggcgggcgcctgtagtcccagctacacgggaggctgaggtaggagaatggcctgaacccgggaggcagagcttgcagtgagccgagatcgcaccaccacactccactccagcctgggcgagactctgtctcaaaaaaaaaaaaaaaaaaaaaaaagaattatacctctgatttttaaattgtttttaactttttattttgatgtagtttatttcaaaatatttagaatttaattcaaaattcttattttgaaataattttacagttgagtcgcaaaaattgtatagttttcatatatcttctatccggttttcccttatgttacgtcacacataacaacagtatgacagttataaaaagtgaacaattaactttggtacagtactattaacaaagttacagaatttatgtagatttcaccaattttcccctaatactcttattctgtttcaaggctgaatccaggatcgcatattacatttagtcatgtcacctcagtctcctccagtctgtgacacttcctcagtgtttccttgcctttcatgttcttgacacttttgaagactactggtcagttgttttgtagaatgtccttccatttggttgtctgatgttttttccatgattggataggggttatgcacttttgggaaggacaccacagaggtgtggtgtcctttttagtccatcatatcaaggggttcaggatgttgatatgtattgctgatgatattcatctcgatcgtttggttaatctgccaagttgtgtctaccatattcttgactatgacttttctatttttctccttgtaattgctgaataatttggagtgatacttttgagactacacaaatacctcaaacagtttcatttaaacttttgcaaacaaattttagcatccattggtggatcttgcttgcagcaattactactgtggggttctggtgatcctctgttttcctcattccttctatattagttatttagagtttttctctaagggagagctgtccctcctcccctgtttgtttattcagttattcatttatatcagcatagactcttaaatatttatttattcttaggtttataatccaatactatcatttgaaaaatttttgttgctcaagttatttcaactttggccattggaagctcttccagactggctcatatgccctttaaacaggccccattctttctttgttcaaaaaaaaatttttttttgaccacttctttactttccggcaccaaaacgtgctttgggtttatcttgtattttccttggttccttttattgaaaaatggtacttagaaaccaagatttgagtgcttatatgtaaacattgttactaagatatcacatataaacacacatctatatttctacctgtatctatttatctgcatatacatggattttaaaaattgtgtgtcactgttgagacctctgactctaatgcagcaccaaagggtttattctagctttctcactttctgtatctgtaacttccttctctgaaggtgagagcccagctctcattatctgcaataaatttacttactttcctcctggaacacaaataattttagaattgttaacccacaaccctgtgagaaacaaatttaccactgtgcttttttcttttagtcttactagtacccagtcaaaacaatgctttccaaagtgatttaggtcagttcttttttttcctcactaccttcacggtggttatatgattcatttataatacggttagatttgtcccaggctgcattccttcctttctcccacatccttgctgatttaaaaaaattacatatattaaaattcactctttatggtatacagttctattgatttagacaaattcatagagttgtgtatccaccaccaaagtcccttacaaaatagcctcatcattagagaaattcccttttgctgccccttcatagtcatccctacctcatgcctcaatccttggtaaccactgctcctgttttccatccctatagtttttgtcttttccagagtatcagaccaatggaatcatgtaaaatgcagccttttgggtccggcttctgtactcggcaaaacgcacttaagactcatccatgtttttacacaaatcaatagttcattcatttttactgctgggtagtattccattgtatggatgtaccacagtttgtctaccccttcaacagctggaagacatttgtgctgttcccagttttggccgttatgcttaaatctgctataaacattcatgtacagatttttgtgtgaacatcagtttttgtttctctcaagtagatatcaaggagtgtgattactggtacatatggtaggtacgtgtttaacttcattggaaactgtcaaactcgtttccaaaggggctgcaccagtttccattcccactagcaatatatgagagttctggtctctctgtgtccttgccactgtcatttggttactctgcaatttcagctctacagggggttcaggaaaagtcataaatttgaagtgactttgattattttttcatcctaagaatgggaggaatgctcttttaaactctacatcacaactagaagccagaagtggaaaaactttgattttaagtttaaggaggtaacacaagtttaactgggaaattaaggtcaaaaggatatacttacattattctggaataaacagagctgcattgtatagagacacaatgtacagggagattaatggagataaacacatcactttctttgagtagtctcctttaatttttttcatgccaagtgactagctctcttccagatgttcccagacaactttgcctataatttacggtgctgatattacactgctttatcattattagttaatcacaggttgtatatttgaattcttatgagatcatagagattatgtaaatagatcttgccaaacataacacaacgggaggagtggagtcagtgcatgctatgccctactttaaggtagttaaaattaaaactcatatgtgtgtgtgaaatggagcttatggtccccaattcaatctgtgtggtgtgtggctgtagattctgtaagcagtggtcagcatagtgccagcagcaacacctagcaggtgtttgtttgacatttattgagtgaatgagtgaatgtcacagaatctggcaggagatccaaagcaataacaattagattaaaacagattgttttcttttcttataatctttgggaaccccagtggctttttttaatatcttatggaacttcttgtcccatcacaggttttgacagtttctacatctacatgtcatgaggaaccaaaattgaaataaaattaaaataattgaaataataaaggatgaggctcaatttcctaaagtagcacatggactatttttacatcagttgttgagtcaaatgatgacataggaagatttacttttttatttttatttttattttttgagatggagtctcactctgtcgcccaggctggagtgcactggtgccaacttggcccactgcaagctccgcctcccaggttcacaccattctcctgcctcagcctcccaagtagctgggactacaggcgcccaccaccacgcctagctaatttttttgtatttttagtagagacggggtttcaccacgttagccaggatggtctcgatctcctgacctcgtgatctgcccacctcagccttccaaagtgctgggattacaagcatgagccaccacgcctggccgaatatttacttttttgccatgtaatatacctagtttggtttggtgaatggcagagagatatttccttaagattaaaaattacctaagcaccactcatgttcatctgcattatctcacaaattcttgtaggctatgggactatttaaagggagatatttcagagaattgaaagaggtagaatggctgttttaagctgccattcattcctaaagggtgatatggaattttagattaagatcaatacttggaggtacatgcagaggtgacaaagtagaatctaagaactgccctggagtctaaactgggtgagacttcagtttttaagaaaaactgaaggaacagcaagatattttttttttgtacttctcagttgtcattttttctctaaaggactgaggaacttttcttgaggtagagtgggagcaaaaggaaaattataggttaggagataaaaagccttttgggcagaggaaagactgtggtaatggagccagcagatctcaaggtgggaaggatacatttatatagaaggaaaaacccagctctaacaaagaattccccagggcaggtaagacagaagaataaattaggtacaaagtacaagaatccctgaaaaattgtaatgtgaatgtaaccacctgttttctctgagctagacattccacatccacttagctcatgatcacccataattaccatgacactggccaagtttacattagtcagtcaacaccgtgtgttttctatctctgttactgatacttaaaaaaaataaataaaggcttcttgttcatgcttctgtttaccctactgtctgtagttcttttctctggtttgcttcttagtatccaaaaaaatccaaaacaaaacaaaacaaaacaaacctggtctgcagtaaaatttatctgagtcagtttcaacccagtgtttcaaataccacacatccacaccaccaaagcattccttatttcttgatgtaattaatatatctttatgccaagttaatttgaaatcttgcttcaattttcccttcatgtgattaggcacttaagaattaggtctcacaggccgatttacataaataatgaagttgatttatgctttccatgttggcttttccctctattgtgtaaataaatgttgtaatatacatgcagccttcattgcaagtcctttaccttttctagcacttacaaatattaacactgaaatactaaagagttctggctttcatgggtacattgctgccacatcttatcagttcacaaaggaagaaatgtgaatttcatgtgaaaaggcagggtttgggaggatgctatttataaatgacaatggctgaaaagctaatgtgttgatcagacttctacagctttggaaaataatggaggcaatctccctctgcatggttgtcactgtcgagcccaggacataaatccacagcatttaagatgacaagaccttgtatttacatagagactttctccaaggaattcacatcacttcttaggaatggctccattaattcttatagcttagggaactagagtggaaagatatatctttatgggcagttgtcataaatgaagaaaccatgcctgaggtagatttgtaactttctcaaggtcactagccaaactgaattaccagaagcgtggaaatccagagtagtatcaatttcccatgttgggggaggaatgtgtgtgtcacatggggttggcgaggaacatggcttttcagaaactgtcttctatcatttttactcctctatgtcatctgtgactgagagacattgtctttggttagcttttcccaaaccacgatcctctgaacactgggatatgcaagacaccaatagaccttcacaaagaagaaaagcctcccgtggccaaataagtttgagaactgcttcatgctgtaaccactccttggtgattcataattcctattagtgcagttaaagctctgagaagccctgtagtgaagattacctaagtttgcttagtacacagtcccccacacttacttgaccatggaagtgaagctttctttatacagcaacttttaatgatttatagaactgcttttcagtggatcaacggggaaatatatttcttcgataaaagctctggggaggaaatgctgctctaaattaccttttgttctttgatattgctgggcgcaccctctgtattgaggcctcattcacagatgacttgggtggtgtttgagcctttgagatgcagcagatactctcagtgctgaaagctaaggttctatgggaggaatgaaatggtgttggaaaatgacccaggagcaatgccatagccttgtgctccaatctccttcccatacctgcctagctctggtttattatacactgtgatatggggacatttacttggaatgatggcacagtgtgctgtgtgctgggcactgaggcaatgaacaatcacagatcaaatagcaaatctggtacagaccaagcaccaaggaggagccaagaaccaatgggacaagaactaacaggagtttagcactgtggtgcagaagagtatggctctggaaattcaggggactacagaaaatggggagacaagaaatatgtcattcagacagagcagtaagaattttacgtagaccaaaccttaatagactgtcatggggcatcccaggtaaggtttcagggcaagggcagggttcaagatgaaatcccaccaagaggtttcattcaggttgctcttgtacattggttaggcaagtcagcaatagcatgttttagtcattgtcttacaggctgtgataaaaatgctgctttgaaagttgctaactgaaaactacttggaaaacaggtgtctgagatagagaccaataaccagcagaaacttatttttttataggaaaaaacactacgttgaaatgatcagctgtcttaataaaaaagatagggtgagaatgcatagatgttgggtcacgttcagatgctaattctccttccctcctttctcctagccaatcaatgatgtcctctctccaaacatacagatctctaccttgctcgagcgaagcaggagctcttgttctctaaatgctattttaactcttttggaattagataagaagggaggcacctggaggatagtattggaaagtgacaggaggccgagtgggggggactaagagggtaaattggggccagttatgaggtaggtttgtaagtttctcaaggttactgtggccaaattgaattaccagaagtgtggaatcctagagcaattatcaatttcccacgtggggaagaactaagaggaggactttggctctcattagagagttatacctcatgtcatgagttttttgttgtctggaattttgtttggatgttgtctgtggggtttctgtttgtttggattttgttgtctggaaatgaggggccggcaaagttttgaagttggattgtggcattattggttaaatacctgaacctgctcaggtatttaaccactcttgcattgccctcaccctatcattcccaccaaatgaaggaccctcttctctgggaaatagcctgggccatacggagaaagaagtaaataagataggtaatcatatttagtgagtcttaggtcatgtttaaacatggtaagtaaatgagattactatatgtattttctttgattatagtaataaccaagaggtaggttattattgttataatcaattataatgcacaataagcaaatgcagaaaatttaatattaggccagccagaaattttgttgggtttacttaagagtaggttttcttaagagcagagagaccattctctcctgggctggtgaccctgaagataaattgggctgtctgatggcctttaattccacacatatactatgcatgggtgtgtaagtccaatcctctaagaagcagatgtcaagacaggattaaatatacacggcttttggagctgagaaaggctgagagagccattaggccacaatgcaagtgtgacctgagcgaaggggaggacaagagatttggtgaaaaaattttagactggcgtgcagtcaaaaaaaaggtttgacaaggttgtcaggatgtcccccagccaaccttggccatcagaggtattctatgtctcttaggaatgtgactgccttacttagtacccatactaggctcagtcattggtgaggagcagcctgtgggaggtgtgccctgcacaaatacagtaatgaatttcaaagtccagcagctagagcccaggtccccagtagctggaagtcagaaaggtgcattctattggctgcaacaatctatatgattcaagcttcccctgagactgtacttctacttgttgcattcagagggagagtttcacaaagaaggagagacttgtgtttagaaatgggaggatgagggcaattcagagatggtcaggtcggtaacatatgaacatgccacttgactgcttaagtagactaggctgatttgcagctcattttaatatattctgaaaactccatggcatctaatgtcttcttgcttaaaaagagaagtgattttacagagagggaaaaggtaaaatgttattttcaatttctaggaaaagttgtcagattcaggaagtttttgacacttcattataggtagaagcactttgtgtagtctctttacattttatactcaagataacttttggactgatacaattgttctaaaataatgctgctgtcaaataagaggcaaaaacaattagacagaagacacttttgtttgaaatcagtatgactgcataaaatatattaataaaacatagtgaataatctcgatctcttgataaattgcccgctctgcagagcatgggcagctcttgtagcatctattgagaaaacaaagaaatcctgtcaagatgacatctgcttcttctgtggaacatgttaggagtcatgaggttttgaatatgatgcagttagcagcatcatgtacttaataagctggcatggatgaatgcttgccttccttttggggcctccacagattctagaatgccgctcgcgtttggatttacctgaaaatcagcatggcacttagcttaaagaagccgattgaaagtgctatccccaacctggcatgtcagagggtgctgctggctgcgtgccaattaactgtggtaagatggggctggggtggcgtaacagttaactgtggccacaataatgtgtataacaaacaaccacagcatcaaacaacaaaacggcaaaaaacgtatcagcaaacaacaaaaagtgagtatttggctcacaaatctgggggttgcatggggtcagctgatctgggctgggttcagctggggcaatttggttttgttctatgtgtttttcatcttcctcctgggatcagtgggatagtctaggtacgttcctctcatttgccatcttgtgatagcaaagacacgagagaaagcagaaacacaagttcttttaaggccaaggcttggaaatgacatactgtcacttctgcctcatttacttggccaaagcaagtcacatggccaaaatgacagtcaagagtcagagcagtatattctgcccatcaagcggccatggcaaggatgtggatgcagacagttgtgatgaattgaagcaaaataggcagtttaccagaggaacaaattagacctgtccactttgatcttttgtttaatccaagttacctaggaaaactctaggtgactcagccccaagcagggtacaagttcttgactctccttctgtggtagaagctgttagccattcactaaaattcatagccacttcttgggaacacagctttgctgcctttcatgtgaggtcatgtgactgagttatagccaatgaaatgtgagtgaaaatttcatgtctggcccaataaactttcctattcatgtgtctctatgagctttttctcttccatctgacaaagatgacgatacctcaggttatctcagagccatatgttgaaggcggcacagatgttgtcaacctagtttcccagatgattgtctggaaatagagcaactccacctcattctgccctaagcctgtacttactttggactattatatggtgagagaaatgaactttcattgtgttgaaccattatagttttggatcatttaacagcttgcttagaccgccctaactaatacatctgtcatatctccatcttgctccttacctcctgtacctgtttactcctgacctctggctcacttattctcagctttagatttgacttttcaacatgataataaaataatgtcttcctttcagactcttattccttcttcctggactttttttttttttttttttttttttttttttttttttttagagcctgtggctctctagttgctctgggatgctcttaaaaactactattccatccagaaccatgccagctcccatgattctatctctgaattatctagcatagtttatccctgctgcttgtccttcacaacaagggatcagacattttgtccccaaactaaacatctgtcatgaggaccatactggtgtggaaagaacataacaggatttaaggtagaacatgcctgagtttgaatcatggccctggtacttaccagtggtgtgattttgagctcaatgtttagcttctctgggcctccatatcttcttttggaaatggaggtaataatacctaccttataaagttggtcttaaggatcaaatgagataatgaatttattatttttagcacatggtacccaacaagtaacattaattttagtaccatctttataattattattactatatgtgatagactgattgtcctgaattttcagtcctttttttttttttttttttttttttttctgagatggagtcttgctctgttacccagactggagtatagtggcatgagctcggcttactccaatctctgcctcctgggttcaagcgattctccagcctcagcctcccgagtagctgggataacaggtgtgtgccaccatgcctggctaatttttgtatttttagtagagatgggattttgccaggttgcccaggctggtcttgaactcctgacctcgagtgatccacctgcctcagcctcccaaagtgccgggattacaggtgtgagccactgcacctggccacttctttttgtaactatgctctttgccatgtaactttaaagtccttctctgattacctcattttgagtgaagtattttctcttggcccttgacttgggcttggccatgtaacttcctttggccaagctgtgatgcatgtagggacttttaatcacttcacgtgtattaaaaaattataacaccactttgtaccccatacatacatacaactataatttgtcaataataaataaataaatacaatgtgctaagtagggtctaatcttttatacctctgctatttccattagaaacacagattatggctagccttccaaccccatgaggaggatgagagacatgtggaacagagcagcttcagccaatgcagcctgaagcagagccatctcttatagctcatagatttgtcaacattttttggaagctcctaaggcttggagtgatttttttatatagtgttattgtgatcatatctaactgttacattcggaatagttagaagcccaatagttcagataaccctgcaagaacccaaggtaacctcatgtgtcttgtcttgggcctccagagatacctggggtcatgtctgagctctgtggcacaactccacaagcagagtgcatatgcagaagatgagtaattgtgaaaactggaaatcatccttacatcctcccactgtgctaagcaaaccactgcagtgttttgtaggtacctgataaatgaccaattgctttaagttggttatgtttcaaccgcaaccattcttttctgtgtataccagcaattctcaaacattattactaattagaattaccacaagagtttctaaaaaatgttgctgcttgggttccactcctgacctactggatgagaattttaggcagtaggtagcacataggatgtgtttaaaaaattctccaagtaaaagcaatgtacaggcaaggttgagaaaaactgatttttttttcagagcacaaatttctttttcaatttaggtgaaattcaaaaacatataattaaccatgtttaaagtaaacaattaagtgcagttagtagattcataatgttgtgcaattatcacctttatttagtccccagacattttcaccacccacaaaggagaccctgtatccagtaagcagccgtcctccaattctccctatccccctgtatctgtttactcctgacctctggctcacctattctgaggtttagatttgacttttcaatgtgataataaagtagtgtcttccttttggactcttattgctttttcctgaacaatttttatttagagcctgtggctctccttgctctgagatgctcttacaaactaccattccacccagaaggataccagctctcaagattctatctctgaattcccactataggttacccctgggaaccattaaattgatttctgtctctatggattagcctactctggacatttcatataaatggaatcatacaaaatgtgaacttttgtgcctggcttctctcattaagcataatgttctccacgttcatctacattgtagtatgggccaatgcttcctttctttttatggatgaataatattccattttacggatacacaacattttgtttatccattcattcaatgatggacataggttgtttctaccttttggctagttgctatgaatatttgtgtataagtagttgtttgaacacctgttttcagttcttttgggtatgttcctaggggtggaattgctgggtcatacgataattctacgttaaattttttgaggaatcaccaaactatttttcacagcagatataccattttacgttttccctagcaaagtataagggttctaatttctccacatcctggccaacacttgtttctttaaaaaaaattcttatagtcatatcataattgtgagagtaaaaaaaaatactctggatactagacccttatcagctaagtgatgtgcaaaatttttccaccattttgtgggttgtcttttcactttcttgatggtatcctttgattcacaaaagtgtttaatttagatgaggtcaaatttatctacttttcattgttgttgcttgtgtttttggtcatatctaagaatccactgtcaaattcaaggccatgaatatttacccctatgtgttcttttaagagtttttatagctttaagttttatatttaggtctttgatccatttgagttgatttttgcagatggtatgagataagggtccaacttcattcttttgcatatggatatccagttggcctagcatcatttgctgaagagactattctttgagaatcactgattttgataagaaattctcacagttgtcactcagggagactcgagtgtaagactttgagtgtaagactctttgtactgagtccttcattggaaggaggagaggttctgttacaaaaagagagagcaaaaacagggacaagtggggagaattgaagtaaaattgacatggaagttggcctcttggagagattatagcagtctaggaatattgccaaaggaatgtgataatttctaacttctagaattttcgttatcaatgaattaataggcatgtatcgatccattaggaatccagatggctgttgaaaacttggcaaacggttagctattatccagttaattggatagctaccatatgcagcagaaccgtacttaattggctaagggtctgaaaatagggatcagtcttggggaagaggcgtacccagagtgaggctaggctaggcaaggcaaggtatggtagactgatgattaaaatggctacacttcttcactccttcatgtatacaaggccttttgcaatgtgacttctgcaatgtgagctccttccatcaagaggtaaagctaatttctcatactttaaatctgggctggcctcatgattctctttggccaatagaatgcagcagaaatgactctgtgctacctccaagcctaggcatcaagacgctttgttcacttctgctttctttgtcttacaaccttgactaccttccacgagaacaagcccctgttggaggctaggagactttgtggaagtgatctgaggcaccccagtcaacaaccagtcaacctccgcaagcagagccaactagtccacccacagctaaccaagattccatgagacagcccggctgagaccagaataattgtccatctgagcccagcccaagttgccaatcctcagaattatgatataaatagttgttattttaagccactagttttggaggtgatttgttaaacggcaacaactaacattacacagggtatcaatctcctgctaaatgggctgtggataaggatggaatttctcaagtccaaggctagggtaaggtaagggggtgcccagggaacatttaaggtggcactcactctcggggtcatgcaagagcaggttggcacttttgtgcacctgagagtgagtgcctctttaagagtgaggtgctcaggcacagaagttaaagaatcaccactttcaggtgctgatgctatactttgtccggcctttttcttctgttctagatgggcagtgttgagagtgagagctaaggaaggcaagtaaggcagactggaccacagagaataagagtgatggcagggaagctatgcatcaggttataggtgttctcacttattgtcttgagttggggctgttggggaagataccagatttcagatgagcctggtgggaaaggaaatcccaggtgcaacacaggaacccagctattgtgtttggaacaatatattccaaacttgtgcatatgtcaggaactagaagaggcctcaacctgggctgctagttgactcagttgagctatggagagcaagtaaggacatgggaagggagccaggctgtcatcagctctgtatacacccgctccttggcctactgctcctttgacttgttagtcagaggacttgtttgacttgttagttagaacaaacggttagaattcaggaaataatgggccacttttagaaaagagctgcctggcagaagatgcttcagaacaaacaatttttcatgatcagcagcaatagattctttcctccaattacagctgccacaatttactcattgcattgagtagtgacaagcaatttcagaagtgacaaggatagaccatagccatgcttgcaaaacctgggtcagacttaacaatgataatttctagactctcacatcatcaccatgtttattgtaataaataacaacgatgatggctttttagacttagggatgggaattgcccaaacagtgaagtggaaaaataataggggtatgtattccttgggccaagatgtgaacagttttgaagatacaatttacattgtaaacactgaagcttcctggataataaaggcatatttgagacaagctttcaattcttagcttgtcagtctttctggaatatcctaacctctctataaatgggaaaacacaagcctttccagacctgggtagttaatgaaaccagaggaaaggccatttggtagcctcatggttccatctccagaaaccttgcttctcactaagcaaaggtgcactccctactcctccatcctctttggtattatctttatccagtctgagactgtcccggccctcagttaccattccctcattcccttgctagtttaccttttaacatttcccagacttccttcttggacagagtttcactgtaaatgaatgcttttaatatagttacacaattgccccctctcctccccgccttgaaactacaaccacgtggatgctgttcattacaaccactcctcagagacctgggacctagggatgacttcgcattctcccagagaagccaggccattgctattttgctcttattaggaaaccactctttctatagggctcacataaaccagtcattcctgagacctctttctttgcactgtcatctacagcttcttggagagtcactgaggaccttgcccttggctctttctcacctttttccattctatccaaatgtgattattacaccagataatttgaatggtaggtgggatgggagagcctatttcaaagtcatctctcttagcttgtgtgtcgttgctgaagtttggtaattttgtctaatatttcaaatctccacaaattttaactggatataatttgactcatagaacttaaggaagcttgggtggccatcttctttataactaagtccctacctatgaaaatgctttcagaactctggagagaggaatttcacgcttcccctcaatgtattgctactgtatttaagttagtttctttgatggtagtcttctgaacttagagaccatgtcttatcactctctatcctccattgtgcctcaccttctgcctggtacagagtaaatccctgtgggtgtgttggtgcaatttttaaactttgatgcaatgggagatggacaggtaatcaaactatcttttcttttaaaaaaataaaaataaaaattctgaatgcccaggctactgtcattggcttggcctacattctccgtataggagtatacagaatatggaaagtagacttgatttttttcttagccaattttgagctcaaaagaatctgatgactgctaagaaagaaaaaccaatgggaaactaatgtataatttatttgctacccggtacccaaaggaaacatctgttgtgattttataagcctgtacaaattcaaaacaagataagtaaagaaaatgtgtctatttaaaagacagcatagcagtcttctctaagcacattaaggagagagatgtctgcagctttatttggcaattgtatataatctcacaggcaacacagctattttattcatttaattaaaaatggaaactgtattacaatgaaaaaaggaagctgtggaaaatgatgaaccacactccctgagttcccaacctatttctttcattttgtgtgcttaagttttcctggcaattaagatgtttaaaacaatggagcgcaagtacagagttatgggacggctggttaacttcctcataaagttatttcttttaaatcccttgccagttactcggtaagcaaaaacacttaaacatcaatgttaattacctttattagtgctgacaactgtagtttcctgtaatgatcaggtttgttctctgatccatttactaagttgtaaattattattgggtatgagtgctactttaccacagatggaaatacttttttttttttttttttttttttttttgagacaagagtctaactatgtctcccaggctggagtgcagtggcgcaatctcggctcactgcaacctctgcctcctgggttcaagtgattctcctgcctcagccttccgagtagctgggattacaggcatgcaccaccatgcctggctaatttttgtacttttagtaaagagagtgtttcgccaggttggccaggctagtcttgaactcctgacctcaggtgatccatccgtctcggcctcctaaagtgctgggattaccggcatgagccactgcacccagccagatggaaatactttgcaaattctggttttcacaagatttgtcaacaaaatcctcaatgttcataccagcttcttatacccatctgtaaatactatgtaagaaatccatctgtctgtttacctatttactaatcattgtgcccatcgtcagtgtgtttcagctaaaaacagtatgattctgaatatgctgctgcatcgagactgtgacagagttcctgcttggtgatgagtcactgtgaaacactgggcaagtcactttatgtctttggattatatttggcccatgtgtcaaataagagagttgaattagatgcctctcaccttgaaatgtgggtataatacgaggccagctaggtccagcccttaaataaaaaactcccctggtctagtcaggtgggtatcaggccgacataataagactcacctctggtttgatactgtaaagatcataaaacagtaattacttttatgtctccatctaaccccccaactccaagcagtaccagagtgagggtccgataaattactaattactgctcttggattgcttgtaataagacttagcccttgaatcactgtggaagagaatcacatgtccgaacagcagcctgtgtctggatataataacaaccaaccattatacctgtatagtgctttcagcttttctaagtatttcacatatgttttctcattttacccagaatagaacaggggtgatgatgaagatggtctggaagcacattttcaaggaacacgagttgaggttttcaatcttaggcaaaatgaagggctgcatttttcctcagggatgagattgcacttacgttgttcttcctgcatttcattagcttctcacttccaacttgaaagaagactgttcaagttgaaaggcaatgaagacactgagaatgtggcagcaaatgctgaatgtaaagttgaaaaaaaatggaaggcttcccttggaattgaaaaaaaaataatggtcttggcactctaatcattgggtttgggtattgaaacagcctgcagattgtcaaaaccagggaaattgcatgaatctgaaacataaggccagaactgcttgaaaaaaaatagattcaaggatgtggccaggttgctaagatggattgtacaaatttagcagtggtaacttaattgtttttttcctactgttcttcaataacgaaacctccaaaacactaaaagactatcagggctcaaaacagatgggaaaagcagatgcaccttgagtcttccttcaggcagagctcctgcacaccctgggagatgggtgaagagggatgtattttggggatcactgccgatgtgagatttgtccatctcaaaaacagggatctggcttgcccaaccaatggcaagattactgattgcacttaaaaaacccggttacgtgatttctgttataatcattacaaacacaaagtgtatatgtacatacttatgcatgtgtatatatacacatatatatgtatatgtatatatttttatcccccttaaagtggtggtgatttaggttttggatttgctttgtcttattttaatctgtttctgtcaaggctgttggaactttgaaaagccttatggatttcctttggctacaataatattttaaaggtcttgaaagtgagctctgaggctcagactgtctgggggatcttaaaaagcaccgaccctatttaaaagtaggcctaaaacaaagtagaaggaaggaaccatttcttaattgatttggtgtgtgtgcgcggggcgggggggcacctaagaatggaaacatcatcaagctgcttggtttttgttcttgtgtgttttaaatcctaaagcctccctctttgagaaccaaatgggctaacatacgcacatttgcgtatttgtttttcacaatttgttcgggggcagggggcggggtgagggcacagtgattactatcacttgggaatttttgttaaaaatgcaaattctcaaccgcaccgcagacctgctgaatcagaaactctgagagtagagcccagtaagctgtttttatcaagcgctccaggtgattccgatgcatggtccagtttaggcactgtggatgtttgctaatagttgtctgaacaggataatcctctggagatgttaaaaaatactcatgtctgattcccaccctcggggattctaatttgattggtttgaggtaagagctgatcactgagagtttcacaacctctctatgtgattccaatattcagacaagtttgggactcactaacttcaacctactctcttattaaggagcaattttcaaaaaaagaaaaacagcagacagcattgtcagaaaaacaaagcaaaaataggagtttgggggaaagagagaaagtgagttatacatacagaatgttttctgctctatctggaggaatcggagtcagtctccagaaccttttcaaatgatgatcagtttgccaggtaagaatattcttctctgtgtgaggaatagtcttgcctttgtggttgtcacacttcaaagtttatgtcagaaagagtttcccatgggattttgaaggcaaataatataaaaaatagcataaaaaatttgaaaaacgttactttggaacacaagaatattggtcaaaaaccatcagcattgcccttttctttgaggccttaaaatggcaaagttacattttaagtttccatctgttttatttcattgaatcttatagtcagaagggacattggaggccacagataccacaggaataccctcttctgtttctgtgggttggcggcctctactgaaatttcctgggaaacttattgcattacacttgcaccaaccaattgttagaaagttcttagatattaaaaagttcaaagtgaaatatttctgcttataagttccacctattcatctcagttctgccttggagaagcatttctaagaagcagtttgtttaacctgcacatcctgcacatgtatcctggaacttaaaataaaatacaaatgacaaaaagaagcaggttctttaaaatccttctcagaccgaggaaagatgtataactcaaaagtctgatgtaggttttgaggactgtaatcatgtggataattattcataccattttcccctttggttctgaaccaactggaaatacccatagagcttagatatcacggcaagatcaatgttactgtggataaagctggggcttccacctgaaaccatcatctgacttcaactacttccttctgaaccggactctgttacagggcagagccatcatctctatgagtttatctatcatgtcctaccatggtagacagaactcctcacaagctctaaaagaaagagccagcaaagtcaggtctacacaagcccaagtctcctcatcctcatctcttctattgcaggggatgcagcgctggaggaaggcactgggtatggatgttgaagagagaaacccaaagagttccttccatactggaagaagacaggaaactggaagtgtgtggttagaaattctcattcccccaaacactttaatccttctgaacttttttgtatttcaaatatttgaaggcaattatcatgtgccctgtaaatcatctttttcaccttttaaaaaatttaaaatcccggccgggtgcaggggctcacgcctataatcccagcacttttggaggccgaggcgggtggatcacgaggtcaggagttcgagaccagcctggcgaagatggtaaaaccccatatctactaaaaaaaatacaaaaaattagccgggcgcggcagcaggcgcctgtaatcccagctactcaggaggccgaggcaggagaatcacttgaagttggagggcagaggttgcagtgagctgagatcacgccactacaatccaacccgggcgagagagtgagactccgtctcaaaaagaaaaaaaaaaaaagtaaaaccccaagatatccagacccttcgccatgctggttattcttatctggtcatgaatcactttattattcctcttaaggtatgatgttccgaaggggtgtggggagaggcatttcctttgttttctttatatttttattttcagacaactttggtaacttttgatcttgtttaatgagtcttttcttacccaaacgacctaaagataatctctcatatttaaaaaaatattttaacgtattacctctcatatttaaaaacatattttaaggtattacctctcatatttaaatcctacattatgtggagtcgatttttacatcaaggaaggaatccaattttattttcttctgtatggataaccagttgtttcagcatatttgctgaaagcctccaacctttctcctaatttttagtgaccctttggtcatgttccaagtttccagttagttgtgagtctgtttttaggctctctgttctgttactagggtcaattgggctatccctatgccaaaactataatattttcattgctaaaatttgtaaagagttttgataactcatatgagttcctgtatcttgtttttcttcagaagtgtcttgactattcttggtctgttattctttgatataaacgttagaatcagcttgttaaacatcttaaaaatttgttagatttttttactaaaattgcattgaatctacagatgaatttggtgaggaaagacagcctcatgaagtcatattcttcttatccatcaatatacttctccatttatttagctctttgttaatgtcttcagatagttttattttataattttctctattaggatctaatgcaacttgatatgtttgggctgtgtccccatccaaatctcatcttgaattgtaactcccacaattaccatgtgttgtgggaggaacctggtgggaggaaattgaattatgggggtgggcctttcccgtgctatcattctcgtgatagtgaatgagtctcatgagacctgatctcatggttttaaaaacgggagtttccctgcacaagctctcttgtctgctgccatgtgagacatgcctttcaccttctgccatcatcatgaggcctccccagccatgtggaactgtaagtccattaaacctctttctttagtaagttgcacagtctcgggtatgtctttatcagcagcgtgaaaacagactaatacataacttctgtttgatttattcctatgttcctcatattcttttgttgctattttaaatggtgtcttgaaaatctacatgtgttgttcattactagtatattgtagtgtggctataatcttgccaaaatctcttattaaggcaaattatttgcttgtagatgattttagtttttctatacagacaatcaaagtatctatcaggtttatttcttccttttgagttatgatatcttttatttttcttgtctaattgtctgactaggacatccaggacaatattaaattgaaatggtgacagtgagcattcttgttcccactctcaaagggtattcttttaactttcacagtgtggtgtttgctgtcaggtttctttgtctttcgtgccacttaggagcccagcactttctgccagcttcttgtagctggaatctctaggtggccatttccatgacaggttgctttaactttttcaggcatgagaaactcacaaatcttctgtgtcttccagttacagaaagtctatttaagcgctttgggtgaaaccatggaagttcctctgattacacttaaagtaggaaggtagcaccacctcatcatccaacagctttttcatatgaaatatcttcactgaatctggtcgcatttctccattttgacttctctttatatccttgatctggctggggctagatgagtcatgagaatggttcttaaacattcagccagagactcaatcttgtactcactttgttatctgatatccctttatttgtatctcaattaaaaacaagatgggaagagaccaactgtacactggttacaggtctgtattcagctttatgaagcctaaagttcagcaacagtcatcttgttcctgaagaatatgagtactttatttattttatttatttattttttgagatagtctttctctgttgcccaggctggagtgcagtggcgtgacctccttgactcactgcaacctccgcctcctgggttcaagcaattctcgtttctcagcctcccaagaagctggataggcgagcaccaccatgcccggctaatttttgtatttttggtagagaaggagtttcaccaccttggccaggctggtctcgaactcctgacctcaagtgatccactcacctcggcctcccaaagtgctgagattacaggcatgagccactgcgcccagccaatatgagtactttagaaagctttaactttccttacccaatcctgactatcctattgttacccactattttaatgacatcctcttttctaatgtcacaaattagaaaccagtttgggtttatatagtgtttgtctacatttacccatagtttacctagtcttgactcgccattctttcttgcatctcagacatgccttctgtaatcatcttccttcttcatgaagtgtgtcctttagaatttctttactgaaggtccattgcttgcatactctcagtgtgtttgtcctgagggactgtttcccatgaaccaaattaactgcctctcaagaatgccattggtgggaataaaggagaccgatttatcacctggtttccgcttcccattggtctcagtttaacccgcaaggtgttctctctctcacacgactaggttgtgtccaatggggtcactgagtgatgttaccagggaagctcaggagggagacaagaggtgtagtgctcgggtatgaagtaaggtgctatcaagttgctcctactatcaggagcacagacttcaaatttcttgaaatctatgtagagctggtcaccatactagtagcttgtacaagaatcgggtacagctgagaagatatgaagtggtgcaaattaagtggcctattcattgtgtgttttgtgattttctcccttctctttctcttttggtgagtagtatttgcagaaaatgtgtctgtgagaatcctttgaaacctggatttaatgtgctttcctccagaaagcaattgtgtttacttctgtgagatttctagacctcttaaagttaatctctatgatttttttttcaattctcagaagttttgtgatttctagatctaattttgcatgactacaagcttgcagctagacattttcaggagagaccctgccacttctacgaaccaagacgaaagactgagaaagccaaatgtccttatcataactctctgtgaattgaggttttccccccttttcacagtgagtgagtacagcttctaaaagactaggcactataaagaaatctcctcgatacacctaatgtaaatgacgagttaatgggtgcagcacaccaacacggcgcatgtatacatatgtaaaacctgcacgttgtacacatgtatcctagaacttaaaataaaaaaaaaaaaagaaagaaagaaaagaaatctctccaccttttctctttgcttaggcccaatcattgtccctttaaaacccaaaacaaaactctagggcagccaaggatctgcagataacctcagctgcagctgagcagtagcattttgttatctccctggacttacgcttttgtttccttttggccactgaggacttcttccattttcttgctaactcatctatctgtccgtctttctatctgttgcatttttatgtacattccaacctttttaggtattctgtactgggagtatttttccacaatattatctgttctgttaaaccaatatcatagtgctactgaattctaagctaaccattaaggagttagttatttctagtttatgttgtctgaaaattgctaaggatgttatttatatctatcgctagggtcttagcatttctagtgttaagctttcttggaagcctccaccgcaattctatttcttagagttcttttttccttaagggtgaggttggtactgcctcattccctacattctgtcctgtttctaaaaacaagtagataggccctcgttattttaaaaggaaacagataggggatatatcctggttatctttgccatataaaaaatcaatccaaaactttatggcttcaaaaaacaatcactttatgattacattttattttatattatttattgttatcttttgcggttctaaggggttggctgagttgagctgggcagtttttcacacagttgtagtgactggggttggagtcatctcaaaggtttcttcactcacatgcttcaggttgacgctggatgtctgttgaaacctcagctgggctatggttagaacacatgcctggaacaagtggtctctctatttagcctgggcttcctctcagccttgtggctgggttccaagagagcgcatcccaagaaagagagtgagttagaagctgcattgccttttatgttctagccttggaaattgtcacttctgctgcattttatttgttagaagagaattaccaagactggtaaaatttgtcgggaggggaattaggctccgtctttttaaaggaggatcaaagaactcagggacaaccaccacagatttaaatggccaaacataggaaagtatcacatgtttacaaattctaacaaacatttttatttccatggtcattgctcttcaattcctgatccttgttggtggaaatataaatacgtatttgcctttgcttttattactcacaaggctttgctccctaaataatttttttcagaatctttatgtacattcagaatgtgaagatatattcaacctacaataatctttaacatttctttaaaggactatttgaataatctttacctggtctcttggcctctggttttatccccctcctctacaccgacatacttccaagcagtacatctgatcatgtcgctcccatgactaaaaatcgtgggtggcacttcacttccagctcctcaacatggcacaaaaggtcttccatgattggctccttctcctcttttatgcctcatctctcgtgtttcatttgccctttacactctagcagggctaaataccatgcgttttcacatctctgtgcctttaaatatgttgatcccctccctagaatacctgtccctaacttatcttgcctggaaatcgcatgcattcttaaggtgcatccatagcgatacagctgttcgtgtatcggtagcaactcatttttcgatgcacctgctagacctaaaaatcttttttttggaaacctctgagttgaaatctgctcatattctctacttcttcttcttcttggcaggatgcaacaaatatttaaaccttttccttctgacattagaagcagcacttatcaaagtcctgggtaagagctcagcaatttttgagatccaccaaatcttcaaaggatactggtcaatttccttcaagaatggtctcacatcattttgacttggtgacagtacccacagtcataatccatgtggtctccaattgtgagaatatagctttaaagatctatctaaaatatcaaccagaaccaaaacttccctataaagacacgacttaaagaaacaagtaactcagcaatataaaagaaatgcagcattgtaaaaaagtaaatagcattatagaagtaatatagcatataaaatttttaaagcatgaaaactggagagaagaaaattattaaaatggcaattgttgatataccataatttcaattttcctattgttggacatataaatatttcctatttttctttataaacaatatagaaaaaaaccttcatggcttttaattgttttcactgaactagctctgtatctatttatggggaagataccacacagggtgtgttaataaaataaatatttggctttctttgttactacttcttttgagacatttgggaaatactcagactctggtcccagaaattaagtgaacatgctcactgaggcacttttcatattatcccctatccccagacttgcaaacgttaattttttaggtctcttgggaagtggttcatttagaagaaatcttagccaccaatctcagctagctgtttcttttcctaacgtgttttcctttcttaattcagtataatagcttgatatgaattagacaaattccttggtttgaggtattcatgtcaggtcatctgctttactgtctcctacagagatggcagttttgttccttctattggtcattaaaccactttactaaagaagatgctatgacattagaaggatcaggatttatagaccaggggaatgattttataaatggtatctgtccatctgctatacagaatgttcatatccttacaaaacatgttttcctgtactcaggtcttcatttactgttattttctgcccgcctactaatgtacgcattttggatttctatcgtagctaaatatgcctgtctttttctcttcagtacaaaacaacttgttcaaatccagaggccaacagcttccacatagtgttagaaaaagagtttgcccaaccgaagagctataagctatctatttatttatttgagacggagtctcactctgtcgcccggctggaatgcagtgacgcgatctctgctcactgcaacctccgcctcccgggttccagtgattctcctgcctcagcctcccgagtagctgggattagaggcgcaggcaaccacgcccagctaatttttgtatttttagtagagacagcgtttcaccatgttggccgggatggtctctatctcttgacctcgtgatccacccacctcggcctcccaaagtgctagaattataggcgtgagccaccgtgctcggcctataagctatttattgtgctatggcaaactagtttaacaattctgggtctcaatgttctcatcactaagacagaagtttggaatagataatcttaatgttcagtcctggtagggcatgcagttcacccttatcaaagagacaactgatgaccaacctcccacagacctaggacatgaacctaaggtgcttgacttcaggtccagggtttcaagtctcatttctaatacttcattctcacaaaaatgagtgactttaagtcgtgttatttaaagggggtagtagaggagagatgaggatgatgaggtgagtggtggagaagaactttctgggtagagagattatcatgaagaaatacctaaatgcaggacagatgttggcttatttgatgaactaacagagagtcagcatgactggagtgtagagactgagaaggatagagtaagagacgagggtggagaggtggccaggggccatgtcatatatgaccttttggtaatgttaatgagtttggattcttttcaaagtggaatgagaagccactaaaaggttccaagaagaaaagtgtcatgatctggtatttgcttcacctaagcttcatcagggctttatgtccaatatttaatctccaatagatgccacactgtctggtacatagtaggccctcaacacatttgaggactaaataagtaaatagaagaataaaacaatcaatgtagctgtaatgtgaagaataagtcagaagcatgggaggggtgctattagggagatattacagtattccagccagatgggtcttagtctgtggtggaaacattaacaaaggaaggaagtagatatatttcagaagtatcctgtacagagaaccatcagaacttggtcagaggatggaaggtattgaggatgacttctagttttctagcttgaaaaatttggtagctagaagtagcatttcttgaaatgaggacggaagggggagcagatttgagaaaagaccagggcttgagtttgagcatgatgcagttgggatacctaggagaagatagccaagtggaaatatcaagttatcaattagatgcatcaggttggaggttagaaaggagattccggttagagatgtaaatttgggcactgtccgcaaataaacatttttaaaatagctataggcaagtgcttggaaaagagaagcagaacacaggcctcaagaattcaacatttagagttttggtagagaagaaaggcccagcaaaggaggtagaagaactatgtccaataaatgagggggcaaagtcagaaaagcaaggcatcctggaagcaatcaagaccatttcaggaaggaggagaagcggttaacagtgtagaattctccagaggggaatacatgacaataatctgcattaagattatatgtattagattgaatcctgttaaactgctgtttttgtattaaaaagtggtcaaatattggcaactttgtatgggtcaacataatacacagtttgcttgaaaagtatatatttcagggggccatctcttccattaagtgaggaacacctgtaatcacaattgtaatgtcttctctccaacatctctctgtctattttgtttttgcctaccttcttttggtaaatgtttatttacttggcttttgttctaaagactggggaagccatcgaaacattttaagcagagagtgacaagatctgaataggttttgtttcatttgactgtaaactagtgaacccatttctgttttcacccacagccctttgcctagtgtgtagttcatagcaggaatttgatattttttataggccaaagaggttctttcctcaatgtgcagcacaagcccagtctgaaagtattttctctaatattttaaaatattatcgacatttaaccttcaccatataaattatatgacatcttcagcttacctatcattgttcttattatctaaaccatgacttttgccatttgagtatagaagtgtcctgagttacagagtcaaggctggtttcactatgatgtcaacacagacattggacgaggagttcagaatcctggcatctgttcgctgcatcatgagcaagttcacattacctctggaagcttcaatttctttacttttttggttttcattcttttaaaaataactagattgaactgaacgatttcttttggttttcttttagctctaacattttatgcttctattaatgatttaacattcagatagaatattagtttctttgttttggagttttttgctcagcctaaagaaagcccagtggctagtcagtgttcctgggctggcttcattctccctagaccccctcctagtggcttggttcccctgaaagactcctttgttgccttctcagagtgtccagccaagatagatcatgatgcatcccattgatgttttgtcttatagaagttctaaactagctaccttctgaccaggacctgaggccaatgtcaacatgcttagtttatcccatcaagtagtttttaatgtgaaccaatgctataaaattgggagatttcacacaaaaatttagatttttagtttctttaaaaactcaagatctttggccacatggggttggcattcttttagggcaaaaactggctgggtctgagtagcagtggccccccttttggactggaagttcactctctggttcatgactcaccattctgtgctgctttttgtgccctgcacttctcccacattgactcactttcccagtcattgtagatatttggatttgatccacacaggatgacccaagttggaaaggcacctcaatgacgaaacatcagtgcaatatgaaccctgtccaggtatgcagctcagtttctcatctctttttgctgagacctccaagagtcacgtaccattggtcaaagtattatctaaaaatagtaagcaaattaagggaacaggacttcgctgtgtttagtcatggttttcacaaatgcctcagatcagtgtttctcagccctggctatgtgctggagtcatgtgaggaagtttgaaaaaaaaaatactcatgtttggccgggcgcggtggctcacgcctgtaatcccagcaccttgggaagccgaggtgggcagatcatgaggtcaagagatcgagaccatcctggccaacatggtgaaaccccgtctctactaaaaatacaaaaaactcagccgggcgtggtggcgggcgcctgtagtcccagctatttgggaggatgaggcgggagaatggcgtaaacccgggaggcagagcttgcagtgagccaagattgcgccactgcactctagcctagcaatagagtgagactccgttaaaaaaaaaaaaatgtgtatatatatatatgtttaagttttaccccagaacaactagatcagaatctctgggggagaggcccaagcatgagtatttttttttttttaatcagatgttctaatgtgcagccagggttgagaaacaccactatagaagctccaaatccacaagtactgacatcatcagcctagagaaatcctcaaaaagtctggggagttatttgtggctggttttgcagcctttatggtgtcagtagaaactgtacctaagaatagcctcctcctcacaaactggaatgcccatctggctggggtttccatcacacctggcagtgctggagagatgcacttccagcatgggccatttaaccagcactacctcctttcatttatgtgaaaaatgtagggtggagtaggggtgggaaaaaggcctaaatctagtgttgacaggtgaaaaagagaagggggagatggagggctggtgacttacaatccaaatggcatttcatctattatgaaaaaaaaaaatggtttcaagatcttagcttttaagatgattgaggaaagagtgaaaaataaactggtggtaagacagacaaaaatataagttaagaagaagttgcttctatttgaagtgtttgttttcttccaagtgtccccatttgggttactttgatctagaacatctgaaaaatgacttccctcttggagtgttgttaaaaatttaaaagaccagggaaaaatccaaagtaatgccaaattaatcattgtttccaaagtttccatagataaattatttctccaaacgacccagaataatagggtgagaagaagggctttaaacaagagtgattcaatgacattttcctcgtgtgccttccctgtaacatcagaacaataggctttgaatccaagcctaatatggaattgaaaaattgcagacttagggtttatgatgaatacaacccagctggagcattcaatgaacaatggcaggagggtttggtgaagccaatctggcccgctgtggttctgccacaagggaacgatgggttttaaaggacacaacctaatttctctctgcagctgggtgtcattgactaatgaaaatatattggcacactgctcatgggttattgttccatgtaactgcacctcttagctggggatttgtaagcaggccatgattgaaagcaatatgactgtgcttggttattaaaatattccaaatacagcctgccctatttattggaaacaaagtttgacaagattatgttgatatgaggagcagataatgaaacatctccgtgcacaggcactgccaatgtcaactgggcagaattacagtccttaaatatttatataggaaaatgaaatacaactattaatacttccaggaagtgatacagtgtgagaggagaaatagacatgaggaataggattctgggctacttctaacaggccaatttatcatttttataaaatggctgcatgtctcatttgtggaaactcttcaaagaatgagaaaaagcataaacacctctaaaacctctaaaaatgaggcatgtttaaacaaatgtgttacaaaacctgatgactaaattaatgtgttagaaaggcttcatttttgtaagggcaacttcttctaggataatttaagctctagcctatttatttatttagtaatttgaaagcacactttattaacttggataatgtaattctgttttcttttgctttgtattgtctttgggagaaatgtctaaaagcaaaaaaggtaaatgtccagacaggcattattcaccttaaaaagcacataaaacaatagaaaaggcagtagtctaagaatcagaggatctgagttttaatccgatgtttgcctctagcctgaattgtagaaaagttgctttcacatttcatgcctaatttccacacttacttgtcatatttaccgtctgtattttggcatttgacaatatctttatttttctgtaaatattttaggaatgcatgtctcatattcagcaaatttatgcattttcattatctgatttcttatggtttccatccatttaaacacggagggttatgaacagccacaactttcctggttctggggcctttgggtcccccgccctccagttttccctttctctgacttttgccctttcctcactctgtcactcattctaaagtgacatgctttctgcccctcatcctttctcgatccccttcttttgtcccttagtctcctcactctttgccctttagcagcctcctctctgaggtgggcagcccaggggtgctttttgcaggcttgacatctctctcctgcccttgatggagcaaagtcaattatactttgcttaaaatgctgttttaaaggcaaaatgaaaaccactcaactaaaatttaaaagtcttcaaaaggctgttaaaatcatcacattcaatataaaatggcctgagctatacagtcctcttagaaatacatttttaaataaaccaataagtttagctaattggcaaactgctcatttgctgaatcaattttaaatgaattgcactagagccaaaactggtcttatttttgctcttctctttccttctttccgtcctccaaccacctcctctttttttttcccaccatcttcagtcaatgttcaatttgctgatgatgacttcggtattgaactgaataaagcagttggcaggaatgtgtagaagatagaaaaaaggaacacggcttgattgcagcagtttccagactatgtcccaagtagcatttcccaaagcctcttccagagtttgattcaagagcagaatttgattcaggagcattctggggttgcgaggagaggtcttaaaatatgttaccacttggaattacttttctgagtgaataaggattttctcattactgtgtaataaaaaatgaagaaaaattggatgttgaaactgatgtgttgacatccatagccaccaatttcaaaaatttccagaaataatgcagctttcattagttatatatattgaggttacataagattggattcaggggaaaatggtttcattgttaataaatgcttaagaaccactgacagtataaagaagagaactgtggacttggaaaatgaagaccgtttcatatccataaactactagtaactagctaggtgaccctgagtaaatcatttaaaagttttgggcttcagtttacatgtatgacacaagagagaactgtgttagcatcctttttagaaaacaaataaaaataacgtatatgagtaatatggtttggatttgtgtccctgcccaaatctcatgtcaaattgtaatccccaatgttggaggatgggcctggtgagaggtgattggatcatgggggcagatttcccccttgctgttctggtgatagtgagttctcatgagacctggttgtttaaaagtgtgtagcacttcccacttcgctctcttccttcttcaaccatgtaaaacatgcctgcttctccttcgctttccacaatgtttgtaagtttcccgatgcctcctcagccatgcttcctgtacagcatgcagaactgtgagccaattaaacctcttttctttataaattacccagactcaggtatttctttagagccatagagccatgtgagaacagactaatacaatgaggactgagaatcccaggagatatatgaatgtttaaaaagaagctggttggtgcaaagaaatgtctagtaggtgacaaacgtggaggaatgatctttgtctcacattaatctcatctcatttgtctaatctcatctcagctatgtaacactcacttgctctttctttaccttagcaagtggtcctacttaccaggttgctcagaaaaatataaaggccaatatgagccagtatagagaattcatgaatacccaagggtaccactgtaaggactattctattcctacttatgaggaccttgaagttgacctgcactagatgctgaacatacatgatgagattgtctcatatcccacttttgccaataccactcttctacagcatgtactttcttccgtaaaattcagattcctcaaaagagttattgcctgaggaatcctgaaaacaaaataatagccttgtaagcgttcaggtacttcctcagcctgccttccttgctcgctaggcagccttgattcaaattcctgtcttatacaaattataagttactaagtatcctggatgtgcagaagcattctagcagtgtcagagccttagatactaaatcctaggtggctgaaggtcttttgggcagtatgaaaggctcagactctaaatttaaatacctgaatctgaaaggtggctctgcacttactacctaggtatccttgggcaagctagtaaacttcaggttcatccactataaagtgggaataagaaaaaacttctaggtttaatatcatgttctagttaaatcactaaaatcaatcggctgaacagctgatttgttgaataacagcatttttcaagtgacctattagcctcatttatgaaattcatcaatttgtcaaaaacttgcttcctcattatctctcagacacactgcatttaatattgaatgggatggttctaacagctttagaagatttctgtgaagttttacttgactagttttcatcctgtctttatagcagcatttttaaggaatattcaatttgttacaactaagattggtagggtgctttaatatttgtacaaacacatttagtaaccagaaaatgtatttttctattatacaacattttagaagttctacaacattttagaagttcatgtgggattttttttagtttatgtagaattcctttggatcttctggagtgtcattttctgttttactctgcttttaccatttttaggatttttttcatcacagtctcaagtaggaaatcaacttctatttggccatttggagagccagatacttggcaaatctattttcaacacattgtgctgcttctattaagttcaacacatatttcttgagtgcctataatgtgccatctttggttctgatcatagtaagaggactagacagacagggccctgtttgttcatttcccattccagtggaagagatcagcaatacataaaaggtgataacccctatgaagaaaatagaactgggtgtcagaatagacagtgctatagtactggggcagcagactgctatcttagataaggtggttagacaaagcttctggaggtgaagacactgagctcaggagatggcctttgttgggaggggtagttctaagccatggggcagaaaaatattgctggggtgagacaagaaccaaaagcagtggccaaagacaatattcattagctttgctattgtggttgagggttgcctagcctaaatgtatttcttttcattgtggtatgtttggtttatgtgtgatcattcatataaagactggatgtttatgtgctatttttccctcttctgctatataaatattaagtattggctatattcagaaacacagcagcgccatgggaagatatatatatatatatatatatatatatacaaaacaatcaatcaagttggacatttttggcaaaacgtttccagagtacactttcattgatatagttttaaaatgctgtagcagcattttagtgcctgattaatgggtttatttactccaaagcctgcttgaaactataatgtctttgaaaaaaatattgaaaagatgcttcagaaaagctcatcagcattatttcatttaccatactttcttgtgctaatcttcactctaacaaaaatatcagtggatactaattctatagtggtttatgtaggtaaaagccttttatttcagtacaaaatatatatgcattgcctacagagtaaaacgaaaaataagatatgaaaaacacattgtagagccattttgagaacacggatggggtataactgggaatcatgtctgctccttacagagtgtgtaacttggcatccaagtaaatcacaacaagaaggttgaagagccacttgggaatctatcagataaagcaatgtatcatacagagggtcagtgaagtattggtgctgtttgagagtctatgaggggtttgaacagcaccaccctgtaagctttatttcaggggactggagacctgcctgtgcatctgtgttacctgggaagatttctgggccttatctcagacctgtaagtaacaatcttgagagtagggccaataaaaaaaaataaagaaatgctttccaggtgattgtgatgcatgcacagggagcaggtttattttcagaaaccatctttgtatgttaagagacaaaaccaaatccagaaaagagaattctagaatagcttgcaagttgtgtttccatagaaggatgatggggtcacctgagttggcaatggagatggcagtggtaagagggaggccaaacagacagggctttgaagccctggccctacttcacaaagcaaattcatttttatctgttttaatgtttttatttcatgttgaaatattccggtcttgtacttagtagcattaaagtaatatgcacccagacatgttgtgtggaggacagatgatagcagagaagctgtaggatattgtaaagcagggcctgacacagggagagatctcaggctggatttgttttaattctgtgcaaacaaacggtttgtgggccctcatttccacatcaacattttcctccttgttgtccaaagctctgatctctgctggaagggcctgataattaaactaagctcttgacaggagagttgtccgtggttgggtccaaaaaagttattgggatataggcaccatgccattcttgctaggcatccatgagtgatgtagaggctgctgttaacaggaggtccttgctgcttggtgacaagcaggctaattattatagctccttgctgcacggatgaagtgtgggactcaccagcacctggctggatagttttgggaactggcttagcttccttatgcctccctggttctggcaattgctggctctcacttgagcaaagaccatggtgtttctcgagtgctgactcagctcctctctttgtggttacttcatttagtcctctcatctcttctcccaacagcctctcttctgggtaatgtttctctttatttcccccccctctgcttgggaagcccttgtccggacctgtgatgaatggtctgccctttcctccattctcctttgattaaggcataaactttatgtcttgttccttcaaggtttggccttttggattccaaaattcctaactcttgtttatcaaacatcttggacttcaagtggccatggtatattttcattgggggtgagtgaggaatggtaattatgtaaacaagaaaggagtttctaaataacatattggttaatttctcaaaatattaccctattgttgtgataggggtccaatatttaagacagaagaaatgtgctgaaaatgcagtaaataccattttttaaatccagtaataaaattacagaaacaaaagagtgtgccctattgtggaggaatttgaaatgaagagtcatttcatgaacaaaactttggatgggttgaagggtaaggccagagtcatcatggcaggttcgggtgtcaaactaataaggaaggccacatatgaaaaaaacagttccatgtttactcaagaacaggaaagaactattactaatgtatcaactatgtgtatatagacaaatgtattcataatatgtatatacaacaggtagacaatataatggcttttcacagacattagccagtggctacagtaggaggagagagaaacaaatctattttattgtcttgtctctttgtggataaatttccttccacaggatatttgttatttaagtaaagccctgcaatgaacagagctattagcctaagaaatgttgtgagtaatttgccaaggactaaacttatgagtctatgccaggcaattcttgtcaatagcttgtctgagagaaacagtatctgcagaagcattgtctgaaggacatggaatccattcatttctctcagaaattctcaatgaagctgtgatggtcgtttgggatattagacatctttattgtgtaaggtgtaaggaaggggtccagtttcagttttctgcatatgggcacagggaagggaacgtcacacaccagggcctgtcagggggttgggggaaaggggagggacaacattaggagaaatacctaatgtagatgatgggttgatgggcgcagcaaaccaccatggcacatgtatacctatgtagcaaacctacacattctgcacatgtatcccagaacttaaagtataataaaaaaaaataagtacatgaaaaaacaaacaaacaaacaaaaccaacaaaaaaagaaatctttattgtgtgggactatcctatgcattttagtatctttaaaattcccagaactttcccactaaacaccagtgatgctcacctcgcatcactgtgacgagtaacaatttccctcctacagttccaaagccaaagcacccctgcttaggtaccactgctagacaacataaaatatattaactgataaaccagagaactgagtacttgaatcaattatataggcaacccaatagactcctagctggtattatactttctgagtcacaactcagccgggcgtggtggctcatgcctgtaatcccagcactttgggaggccgaggtggtggatcatgaggtcaagagatcgagaccatcttggccaacatggtgaaaccccatctctactaaaaatacaaaaattagccaggcatggtggcgcgcgcctgtggtcccagctactcgggaggttaaggcaggagaatcgcttgaatcctggaggcagaggttgcagtgagccaagattgtgccactgcactccagcttggtgacagagcaagactccgtctcaaaataataataataataataataataataataataataataaatgtacaaaactatagctagtgataggtggtcttggtagtcttgcttgtgccctcgctctctttgatgatcatcttggccttcttcagttcatgaaactttttatgggcatttaaataattttaattaccaattttgaacttttctataattgaggaatgaatggcttaccctccttaagagagtttccatcctaagtaaatagtgtggggatgcgactgggaaagagagttatatttaagagcagaaggcctttgtgtgtgtgtgtgtgtgtgtgtgtgtgtgtgtgtgtgagagagagagagagagaacgaaagagagagagagagagtttcactcttgttgcccaggctggagtgcaatcgtgtgatctcggctcactgcatcctcagcctcccgggttcaagcaaagcggttcttctgcctcagcctcccaggtagctgggatcacaggcacacgtcatcacgcccagctaattttttgtatttttagtagagacagagtttcaccatgctggccaggctggtcgcaagctcctgacctcaggtgatccacctgcctcggcctcccaaagtgttgagattacaggcgtgaaccaccgtgcctggcctttttttctttttgagacggagtctcactttgtcacccagactagagtgcagtggcgcgatctcagctcactgcaaccttcgcctcctgggttcaagtgattctcctgcctcagcctcctgagtaagtgagattacaggcgcgtgccaccacacttggctaattttttgtatttttagtaaagacggccttttgccatgttggttaggctggtcttgaattccttacctcaagtggtccacccgcctcggcctcccaaagtgctgggattacaggcacgagccaccgcgcccagcccagaaggccttttcggcatccctgaaatataacctgagcaccgctgtctgctcagggcctgaagttggaagtggttacctttatcccttgtttatctggatgtcattacgatttttttttcaagtgcagtgaagaattaaagatcttgtccaccaaacaaacaaataataaataaataaactttctcagtcataactctaagaaacttttcactatgtttaccataaagatacttttgtcagcacaattaaactgacctttctgagacagaattgggagatactttgtaccctggtctcagtagcagtggtgcttttcctgagtaactagtttacttttccccatatagatttcgcatagtttgaaagtgtccactttcctatgggcatttggaaacctgagagcctaaagtgttgatccacctctggcatgaacactattgtgttccaaccttacttctggttccctattagtttactgacattatttgtcctttgactcacatttttcatattttaatgggcttttattttgctatgttacagggattttgtaaacggcttgaagttctttatgaatcaaggtaagataacaatgtgtgcacatattcacatatattcatagagttcttggactgtgaaatttgggggatgtaaatgtaagcgtatttgtgacagccaagtaattttactttctctacagtaacaacagttggaaatgaaagtaaaactttatagaagaagagctaaattagagaatttaattattataacagcacaattgtttaatttgctaattgtggtttcttggtacataatccgcatacattaaagagtataactcgatgcttagcagggagcttatcgattactttgcctcctctaattatctaaattttagcagactcccagacttaaggggataaatcagataatttatattatggtatgtgtgtgctaataatattagtttcttgtttttacaaattattatttgtatgtaaaacgaagtgttgaactgattattttcagacacttatagtcctaaaattctcaacggctaaaaagatagactaaatttcccctggaggtgtttgtaaacagcatttctatctaaaaggttagtacatttgtgggaagaagtaactgggtggagagatggaaaaaaatattcctcttattcaaagaccctctgaccacaggaagttttactaatttaatcactactggcatggaccatggaacagatgaataaagttcaaaatataagttcaggcaacaatacaagatgcctgtgtacttaaattacatgttcttgaaggtcagaatacttttatttacaaatatctccatatcttaagtaggaaaatgtttaatattgatctgaaaatataatggctgagacacttaatatttaggtcactgaaaaataaaaataactcaaaccccaaacttcctttacagttcaggaaactagatgctcgaaaacagaggaaagagaaacagaaaatatttgagctaaaattcagataaatccctgacttgaagctgtttgagtgtgcgtgcgtgtgcatgtgtacctgtgtacgcatgtgcgtccacacgtgtgcctcaatatgttttctcttattgtctctcctactgacattgaaacagtgcctttgatttggacagaaagaacatggttgaaaaatacagctttgaaaatccaaattacaaggtatgggctgttattaggatgttagattagacagtggcagcgggacaaggcaaacaggtcacagtgaagttcagaaataaaaagatacgctgccaagagacaactcattgagctgctagccttgttttctcccccataataaaatgatttttgagagactgctcagccagaaaggtaaaccattctcacaatttaaaagtgccagtcatctgtaaagccagaagccaagacagaaggatatttatgaagaagaataggattgccacttaaaagtcaaaagaagataagagaaacaaaatggagcctctatagccaagttaattatttaggggcttgagttcagcttctagattttccctctcctgaagcttttctctcttccttcctttggcctgccttttaaccattaaacagcccatttgaatgagcctggggaaaggaaaaggggaactatactaagtctgtcttacaacagtggttcacccaaagcaatgcaattcaaaggcagagcaaataatcaagttttactttttatctttgtatttcatttttttttcaaaaccagataacgatcatttaatgatttgtcaatctggaatgcaactgtggcacgtgggtgtgcaggcgtgggcagggagctagtgtgagaagtcagcaaaacttaaattgacctattttctcagaaatagggacagctggtaaagcagaacctatcaatgtgggctgatacacaaattgctcagttggacaaatgtatttgtagatgtggacatcacgatgaaggactagatgaatcattctgcccatgtcacttaccctaaaaaaaacttttggcatgctatgttaattttaaaataataataatcactttaaaagtaacctttttcaactttagagcagtgttagatttacaggactattgcaaacacagtacagagagttcccgtatgccccatatccagtttcacctattattaacatctttagcatggtacatttgtcatcattagtaaaccaatactgatacatgattattaactgaagttcatacattattcagatttcctcaaatcttccctaatgtctgctttctgttccaggatcccttctaggatgccacattacatttaatagaagtgtctccttaggcacctctaggttgtgaaagtttctccaactttcctttttttttttttttttttttttttttaactatcttgacagttttgaggattactggtcaggtattttgtagaatgtccctcagttgggatttgtctgctgttttctcatgattaaactggggttatgggtttgtggaaggaagacacagaagtaaaaggttattctcaacacattatcacataaatacaggctatcgatacgactttccactgtcaatattaatgatcatctgactggtatgtttgtcaagtttctccactgtcaacttactcttttttttcccccgcctccctttccatattatactctttggaagaaagttactatgtgtatgtaacatacactaaaggagtgaggagtgaggagctgtgctccacctccttaagggcagagtatctctgtaaattatttggaactcttctacttggaagatgtgtttattatgccccatttatttaattatttaatcacttatatcagtttggattcatggatatttatattataacttgggttgggttataatccaatactactttattgctcaaattgttccagctcttttaattggctcctgtacccccttgtcatacctccatcattatctgttgttttcttttgcattttctactttctggaactatgacatgctccaggctcatcttaatgtggtagattacactgattgattttttatattgaaccacccttgcatacctggaataaatcccacttgattatagtatatcgttcttatttaacattattggatctgctaatatcttgttgaagatttttgtatgtatgtcagtagttaactaattttattttgttttatttattttttgagacagtcttgctctgttgcccagtctggaatgcagtggtgcgatctcagaccactgcaacctctgcttcctgggttcaaataattctcctgcctcagtctcccaagtaactaagattacaggcaggtgccaccacatctggttaatgggatttcagcatgttggccaggctggtctcaaactcctgacctcacgtgattcacccgcctcagcctcccaaagtgctaggattacaggcgccagccaccgcatccagctgcctaattttattctaattaatttaagaacttttttcagctttgaggtgtaatcaacaaataaaaatttcatatattcaaggcgtacaatgtcatgttttcacacacatatacgttgtgaaaacattatcacaatcaggctaattaacatgtccattacctcacacagttactttttttgtggtaaaaatacttaagatttactctcttaacagttcaagtatagaatacattattattacttacagtccaggctgtacattaggtctccagaacttatttatcttaactacaagttggcatgtatgctgatgagagatactggtctgtagtcttcctttcttgcagtgtcatcttgttttagtattagggtgaaggtaccctgatagaatgagttaggaagtgttcctttctgctcttccgctttctgggagagattgtggagtattggtatcattttttccttaaatgtttgatagaatttaccagtgaaactatctgggcttgataatttccttttttgtaaggctattttattgatttgttttttttttaattgataatcttaagagttctatatctatttctttttgtgtaagttttagtagtttgcatctttcaagaaattagtccatttcatctaaatcatcaaatttgtggacatagagttgttcagaataccatattcctatagtatcttttcatattcatggaacagtagagatgacccttctttcatttttaatattgataatttctctctttctctattagcttggttagggttttgttaattttactgattttttaaaaaataaatcgcttttggtctgttaattttctctattgtttacctgttttcaatttcattgatttaggctctaatttttatttcttttcttctgcttgatttaggcttaaattgttcttatttctctagtttcctaaggtggaaacttaggtaactgatttttcaacctttatttttttctattatatgcatttaatgctataaatttccctctaagcattgcttttgctgcattcgacaaattttgacaagttttagtttcattttcttttagttcaaaatattttaaacttttttgatacttctttaagtcgtgtggtctttacaagtgtgttaatttataaatatttgggaattttccagccatctttgtgttattagtttctagttcaatttcactgctgtctgagaacatattttttataatttttactcttttaaatttgttaaggtatgttttatggtacaggaggtggtctgccttggtgcatgttccatgcaaaatggagaagaatgtgtattctgctgctgttggatggagtccttcataaatgtcaattacattaagttgattgatagtgccattcaggtcaactgcatgcagccttaactgattttctgcctgcttcatctaacaattactgataggggtgacaggggatgaagtctccaactataatagtggattcctcatttcatccttttagttctatctgtttttgtttcatgtatctttagaggcattcatgtttagggatgctatgtcttcttagagaactgacccttttattattatgtaatgtctcctttatccctgataaatttccttgctctgaaatctgctttgtctgaaattaataaagctacttcaactttcttttgattagtggtagcatggtatattttctctatcactttacttttaacctatcagtcctcacatttaaagtgatgttcttgtagacaatatataattaggtcttgttttgcagccactatgacaatcactgtcttttaattgctgtatttagaccattcacatttaaagtaattattaatatatttgggttaatatcaaccatgcttgtaacttttttcttatatattaccggaagcttccttttctgtctttcctggtttcagttgagcattttatttcattcagcttttatgtcttcttttagcatagaaattatacttatttaaaaaagctttttagtggttgccctgaagtttacaaaatatattttaaactaatgtaggtccaccttcagacaacattactgcatttcatgtgtagtgcaggtacctgataacagtgtattcccaacttcttcctcccttcccttgggacactgtttatccatatgctataatcatataatacattgttcctattgttacttgttacatataacaagtatataactgtatataataattaagaaaaataaaatattttattttacattcattcattccttctctgacgtagatcctttctttatgtaggtccaagcgtctgacttttacagttgtctttctgcctgaagaaaatcttttaacatttcttgcagggcagttctgctagcaatgagttatctcacttgtttgtctgagaaacagacatttgacgaataatttttatatagaataccaagttggtgatttttgtctttcagtactttaaatatttcactctactctttttttttttttttttttttttgagacggagtcttgctctgtcgcccaggccggaatgcagtggcacgatctcggctcactgcaagctccgcctcccgggttcacgccattctcctgcctccgcctcccgaggagctgggactacaagcgcccatcaccacgcccggctaattttttgtatttttagtagagacggggtttcaccatgttagccaggatggtctcgatctcctgacctcgtgatccgcctgcctcggcctcccaaagtgctgggattacaggcgtgagacactgcacccggcctactcttttttttgtccgagaaacattcacgaataatttctttctatatagaataccaggttggtgatttttgtctttcagcactttacatatttcactctagtctcttgcatggtttctgattaaaagtcagatgtaattcatattctcattcctctacaggtaaggtgtttttattctctggcttcttttaagatttttctctttgtgattttctgcagtttgaatatgacatgcctaggtatattttttgggatttattatggttggcattctctgagcttcctggatgtggtttgctgtctgtcattcatttttgaaagttctcagtcattattacttcaaaaatttctcctgctctgttctctctttttttttttttttcctctttttggtattccaattgcacatgttatatcttctgaaattgtcccccagttcttaaatgttaagtttttttcattgcctttttcctctttacattttagggttttttttttttttttaattaacttacctttagactcattgattctttccttaactattgaatctactgatgagtccactgaaggcattcttcattagtgttaaagtgcttctgatttctagtatttccttttgattctttcttagagtttccatatctctgcttactttactcatgtgttcttgtatgttgtctattttttccattagagcccttatcatattatttattgtaattttatatgccctgtctgttaagtccaacatctgtgtcacacctgaatctggttctgatgcttgctttgtctcttgagactttttttttttctttgccttctggcatggcttatatcttttaattgaaagttagacatgtactgcgtaataggaactaaggtaaatatgcctatggtgtgaggtttatgttaatcgggctaggagttgggctttgttttatgtttgctgtagctataggtaccagaggcttcaaattcccaaagtacttcttcttagagaagatccatgtctttcagttctttcagctgtaatatcctcttgttatactggagccccgttggtatgatgagaaactgtggaggcggtgaagcattctacaaccttccaattaagtctcagccttttacctgacttgcatctttgacctgtgatcaccgagaatcaaaagggaagtgtttcttcttgtatagtttctcccctcccaattaggtgaggaacgctagagggggctatggtgagatctctgggacaaggctctggtaaagtactttcctctgaagacaaggcctttgctatggagaaggttctggacatattttaccaagattatccgtctactctccctacctaagccacaagggtacctttgttgactcttcgcggtgagaacctagtggggatcctggagataaagtcaatgaaaatatggtggccccaaggagtttctcagtctcaagccagtctacactcagcctccagaaacttgtcaaaattactaagtgttcctaccagtttatggctccagtgacttctattttaggtaagcagattgtgtccgtgactccggatttgcctgttaccagatttcagcatggtgatttgacttgcaaatttagttctctgataagtccaaaacaacttgttgagttttagcttatccagcttttgcttgctataagaatgggagtgacaatttctaagctctttacatgtctgagctgtaaccgggaatcacagtgatttttgaagataagattacacaactttttataacacctcggaatggtagttattattctctttattttacacataaaccagtggggctttagtgaaattgtgtgtccaagaccatttgtctgcaagtctaaatggttctaaatcctatgcaccttagtttctttgaaaatagctaaaaacggccgggcgcggtggctcacgcctgtaatcccagcactttgggaggccgaggcaggcggatcacgaggtcaggagatccagaccatcctggctaacacggtgaaaccccgtctctactaaaaatacaaaaaacttagccgggcgtggtggcgggcgcccgtagtcccagctactcgggaggctgaggcaggagaatggcgtgaacccgggaggcggagcttacagtgagccgagattgcgccactgcactccagcctgggcgacagagccagactccgtctcaaaaaaaaaaaaaaaaagaaagaaaatagctaaaaacactatcaatattttcatgtgtacagatgtttatacactgaaatatttcttgctttcaagtttgtgcctacattttgagaccctcagaggcgggggggcagtgcggttgagtaatagtacagggcaatttattatcattagttcaggcaattaatttatcagtttattcctttttcctccactctgctctcccattgcccctttcctagcctctaccagggacaatcattggaaaatcttcaataagtatcttattttatttcatttcgttttaaagatcttatttttagagcagttttaggttcatagcaaaattgagaggaaggtacagagaatttccatctacccccaacatccacacacacgcatacatagagtcccgaattatcaacatcccctaccacagcggtatatttgttacaactgatgaacgtactggttaatgtttattttttactgcaataggctcttgcaaaatgtgtcttgtattatgtgcatgtgtttttaatgcgcataattgctattttcttttctttcttattttttttgtaagacagggtctcgctttgtcacccaggctggagtgtagtggtgcaaacatggttcactgcagcctcgacctcttttcttattatctatttcattcaggttattttttattcctagcactgtgcttttaaaatacatctatactgctctgtgtatgcatcgttggttcaaactactgcatagtacttcagctttattatttctacagaaatattacatattcattgtagaaccactaagggccaaaaagtgagaactagaaaataatgatcactagaaattgtatcatgagagaaccatagttgttattttggtgaacctcctgtaagatacctctttgcacttatgtataaatgcattaaatgtattcaattttacttacataggactgccctgcacatgttattttttgactggcccctctcattcatcactatttcatggataacatctcatgcaacaaatatagatccacaacatggcttttaaagatcgctcagtactctgttgtatggttgcaccacacttaaatagttccatttctgggcattttgcttacatttatttttatttattattataaacagtgcctgcctcagcaaacagccttctgcagataccttctcccacttgtgcaattatctcttcaaagttgaatactttttgcccaccacatgagttgagctgggtttcgtgccatccacaaaattcatgctttttctactgctttatgttgcccaaagactcaaggactgaagtggcttcagctattaaattctgtgagtttatacgtgtatgaacattggcagtgggggaagaagtcacaaaacaaagaggccctcttttcagctctgctccagtaagcaggacctttttcactttgtggcagaataaatgcaaataaatcggctgtcagaaattagtagtttatataatttgattaaaattagagttcaacactaactttgatggaatcagattctcttctaagtattgttgatcttgacatgaaatgtgccagaattatttacaggaacattattctcccagtatttacaactcagaaagatgtatgccaagaatcctctttggtgtatctgttttcccaagatattttgggccgagatttgaaaactcaaaaaatctagacacatatgtttgggtgcatgttcttaaataaaccaaatgtttccttgtttcaatttttaacatgtttggttttcctatatagtttatggaaatctaattcagagttctgataaatcaatgttttttttgggacgggtgggaaacaacgcttctgtttaatgccttagcaaagagccttctgactgtttaaacaaaaactgccttgcttctatgttgcccaaagactcaagggctaaagtggcctccactattaaattctgtgtgtttattatagagaattttttttgatcatggtgggggtgagcatgagatgttgaaataaaaacagctccttacctgtaactaaggtgtaagtgagaaaagcattttgttatggcgatttgctgtaggcttttattagccaatttgacttccaatattacatggaaataattaagcttcaattttttaaaagagtcaattaaatattttagtgttattactactctagaataaactaattaacagttggaacactactgattttgctatttactacaatagtttatttttctcctgggtccacgtgatgaagttatgtttatgctgttattatgggactcaaactggaccagcatcatttttcctcctctcctccctccctcttcttaggtgactgctccacttccccactatgatcaggcctgcttggggaggtcttctgctcccatcgtagactgagcttctgctcagctcagaggtaacttgggggaaggagatttacccttccagtgggaagcttcttgagtcaaagttgcataatctgcataatgatcactcttctttttgatcacaaacattagccttgctctttcagtttggtagttttcctccatcaagggccttataccaccttcctctgggactgggttgccatggttatgggtgtgtcagaactccatcacaccctaatccaagtaaggcaggatatatgttctctgctgttcctgtatcagggccagtttcctacatccctgctggagagttcctcaccatgatatccctggaacaggccaatagttctcaaatcctcttcatgactagggggttaaaattctctaggaccttgggcaggttacttagcctctgtgtgcctcagtttcttagtttgtataacggagataatgaaagcaaacacctcaaggggttgctgtgaggattaactaagttcatatttgtaaagcacttagagcagtgccttggtggtaggaaggagcatatgaagggttagaattagacataccactaaaattctgagatctcagaattatcaaagctggaattctgttctatggtcacaccccactgtgaccttgattgcttaagcataactaatacattttattctaaaatatccctattttggaacactaatttgatcacctataagggtcttttaaatggatatataaaagggactgtatattaaaattaggaatacgtaaatacaatatattctgtacttatacatttgtacaatatattctgtaaaaattttgccatttgattgtcaagataaatttatttaaaagttattggtcagtgtgtttctaagagtcttgaagatctcatgggctagaatatagtttcattcatgcacacatgtacccacaaacatcaaattgttcctatctcttagagaacattttctgtagatccccatgtactattttgtattttcctgtgttttccagtcattagttcaacaaataatctgatgtgaaaaacatgctgtgccaataaaatattctcaaacccccaacaaaccattatgatagtcttatgttatttattatcttccagttctggaggccatagggctgtgttcctttttggaggcttttgaggagaatctgtttccttgccttttctaacttctagaagcctccttcattccttgccccacgacttccttcctctgtcatcaaagccagcagcatagcatcttcaaatctctctctgactcttctgcctccttctttcctttataaggacccttgtgattacattggcccaagcagataatccagggtaatgtttccagttcaagatgcttaacttaatcacacttgcgaagtcccttttgtaatgtaaggttacatgttcacagcttcaggggattaagacatggacatccttggaggggtacattattgtgcctaccacagatttgctcctgagtaagaccttgaatagcatccaggcatttggctctccctacctgacttttgtatgtgtttgcagacaggaactgtgataaattcctaccagttattacggtccctttctttccctctcctcacaagtctttccatacatttaaaacaggtcagatagctgttagtgtttatttaaatgatgaatctactctggagtgttgtgggaaagtatttagtgaggaagacacccccactctttgtgtctgtccttgacagctgcataaagagaataaaacgtgactcttaaagtacatcagtaaagaattacatgatgccaaacgatgacatgggtctttgaagccatttgagaaaacggatatgatttggtccttatgatttttcctgggggaaatgtgaaagtctgaattagcaaattcaaagggagccagagagagatcttgaggacaaggccagtggcttcccaggttctgcatttccagccctgagcagggtgtttggcatgtcagagacgattactaaatgattagtggataaatgacttaccaaaagtatccaaggaacagcttaagccctgggaaagatctggcctttgaaatgtgacctgcaaaacaaaaataatgggtttaatatcctcaggaaagagtacaccatcacattcagttttgtttctaactgctgactcacacagccattcctcactgattactgctccgttgatgtaaaagaaaacaaacccctggtatcactctcctctgtccttatttgaaagatgaaatagcacaactgcttctctgtttattttgctcacacattactattgtttaaatcacaattttcaaattcatttctagcttagtggattgattttttattactcgtgctgagcagttgacagtaatgatttattacatctctgggattttggcagctccttaccactcatggtttaattcacagttttccctgatggctttagtgtctgtggtgtttgctcctataaagtgatgcaccactgggagatgtgtacttctggccctgcactctggccccggttttcttttctccttgctccgtgactgtgttgactggaaggggagagcacattcatgaacgggggaaacctgatgttttctcctgtcctaagacctgcagctattgtagctttgtgctacgtgctggaggctggtccgtttgaaagaggccaagggtggagctgagagagaagggtaaatgcacacatcttagggagatgggctactttttaggcttcataacaatgacaacaaatatagcaacccactgtgccagccacgaggcatgtattagtacaggcattggcaaattatatcctgtgggccaaatttgggctactacctgtttatgtaaataaagttttattggaacacagccacatccgttcatttacctaatgtctatggctgccttcgtgctgcaatggcagagctgagtagttgcagagagactgtatgacctataaagccaaaattataagcccttttcagaaaatattttctgacccttaatcttcatgaaatgacataggctttggtaatatcaacaccagtttacagaagaggaaatagatacactgagatgataaataaaatgcccaaagtcttacagctagtatgaggtgcagagactgcgtcagaagccagcaggtctatgacatactgcctcggatagttactcagagaatgcagtaattgctaaacctgccacattaccgtgtctgtcctatttctttaaatcctcacagggtttggctttatgaaatctttccagacaattgtccattgtctaatggctttgtgggacttttaatttttttaattaaacatttgtgggatttttaactttttaaaactcagaactacctagtaatcgtttgaatcatttgtgtagactagcagttcttaccctcagctacacagtggcgtcacttgaggaactctaaaggtactgccactaggtcccattgcttccatgtcatgatttcattggtttgggatacggtctgggtatgatgctttttcaaaagcatcgagagattctgttgtacagccagaattgagaactactagaacagacaatcgtaagtctcaccctaaaagatatgagaagtctttcctagtgagtcaacaatcaatacaaaacgaaggaagaggccgggtgtggtggctcacgcctgtaatcccagcactttgggaggctgaggcaggtggatcacttgaggccaggagttcgagaccagcctgggcaacatggtgaaaccccacctctacttaaaatacaaaaattagccaggcatggtggcacatgcctgtactcccaactactcaggaggttgaggcatgagaatcacttgagcccgggaggcagaggttgcagtgagccaaaattgcaccactgcacttcagcctgggcacgacagggtaagattccatctgggggaaaaaaaaaaaaaaagaaagaaagaaaaaaaaggaaggaagaaaaaagggacaaataactcattagaaacaggggcccattgtaaacatgttatgagttggtgagcccaatgcaagaaatattccccagtgctaaggataaaaagaaataaactgaataaaatatataataaaaagagatgttaaggctgcagtgaaccatgtttgcaccactgcactccagcctaggtgacaaagcgagactctgtctcaaaaaaaaaaaaaaaaaaaaaaagaccaagaaaatagcaattatgcaaattaaaaacacatgcacacaatacaagacacattttgtgaggataaggaaaattgtgttactttctagacttaatcttcttatttgggcataattatactgactttttttgcttagggtgagaggagacactcataattggaaagaaagagtggaaaaattgaacatttaaaaactgcagtctatttcttctacaagatgtatactttgaatttctctctgttttaacctttactgaagggcaaattaaatcagggctgatttagattcaaagagtttgttaactgacgcctgcctcagggaatgacatcataattattaccagcaaatattgagtaagccctcacgggggactctgtggcactctgctagttcttcgtctctcggaaagtgcaccttcactgcagtgcctagaaaaacataatctcagctgaaattccaaataaatacctcactcctcagattctttccaccgtttctatttgcactgatgatagagccaatgttgttaaaacagcgtgagactgaacattttacccatgagccgagttccacaagctgtctgtaccggctggtgcatcattcccgtaagaagagtgaaattattaaacatcacagagaggtttacaagatttttctgaactatcaaaggtcatgtgtgttttcttggagacttcaagagagaagtggggtaggtacataaaatatctgagacattgagcaggtttatgtctgtgcaaaagtggctccctgttttcctttcttaggcatgactgtcaaaggagcacaagcatttctctgtgctgtggctaggggaaaggaaatgtatgtttaagacttggaacatgggagatttatgggatgttaatgtgtcaagtcttagtaacctctcaagaaggccacttgtgaagtcagactgtcatcagtcacagaaaccaatgcatctgtcttcggagaaattcctcagaaatgtcttccagaaagattatgaaagatgaagcatctcaatacagtgaaaaggtattctataaatgtgaatttttgctgcttctggcaagttctgagcattccctcaactgagaaatgacaaaatgatacatgcatagaatctattgaagaaaatactgaaaccgattaaaggcagctatacaaggatcaattgcatatttgtgaaacttacccatcaaaatgtggctatacaaagtgcatttaaaacacactcacacaatagcatgatacagacttgcactcagctaaaattagataatgcttcctaacgtcaacgcagaaaagcaacctgactattgtagaatatgaaagtgctttaatgatgacatcacaggcaagtccatacatatgtgaatgcaaaaggatataacaaaatgttcagtctaatggtaactggggatctgggacattggcatgttttgcatgtcaggcataatcaatatttaaggttgggacatgttttcttcttgtacggacatagtaaatgaaatagatatctcagctcatatgggctgctttcactgaatccaacaacctatgaccaacaattttataaacaacagaataaaaacccagagaaagtagagagcaaatctgctgctgctgaccatctgttgcttgatcagattcctttaacatcagcaggaagttgtcattttgacagtcactgacatttccccattaagcctaatgtgcataataggcctgaacaatatatatctgcatggcatatgagaaaaataggcacatagaccaatgggacagaatagacaacccagaaataaacccaaatacctacagacaactgttcttccacaaagcaaacaaaaacataaagtgggtaaaggacgctctattcaacacatggtgctgggataattggcaagacacatgtagaagaatgaaactggatcctcatctctcaccttatataaaaatcaactcaagatgggtcaaagacttaaatctgagacctgaaaccattaagattctagaagataacattgggaaaacccttctagacattggcttaggcaaagacttcgtgaccaagaacccaaaagcaaatgcaacaaaaacaaagataaatagatgagacttaattaaactcaaaagcttctgtgcagcaaaagaaacaatcagcaggctgggcacagtggctcacacctgtaatcccagcactttgggaggcaaaggcaggcggatcacctcaagtcaggagtttgagaccagcctggccaacatggcaaaaacccctctctactaaaaatacaaaaattagccaggcatgatggtgggcacctgtaatcccagctactcgggaagctgaggcaggagaatcgcttgaaccacggaggtagagggggcagtgagccaagattgcaccattgcagtccagcctgggcgacagagcaagactctgtctcaaacaaacaaaaaatcaacagagtaaacaacccacagagtcggagaaaatcttctcaatctatatctccaacaaaggactaatatctagactctacaaggaactcaaacaaatcagcaagaaaaaaccaatcccatcaaaaggtgggctaaggacatgaacagacaaatctcaaaacaagatatacaaatggccaacaaacatatgaaaaaaatgttcaacacaactaatgatcagggaaatgcaaatcaaaaccacaatatgataccaccttactcccacaagaatggccataatcaaaaaaatcaaaaagtgatagacgttggcagggatatagtgaaaaggaaacacttttacaccggtggtgggaatgtaaactagtacaaccactgtggaaaaccgtgtggagattccttaaagaactaaaagtagatctaccatttgatccagcaatcccactactgggtatctacccagaggaaaagaagtcattatacaaaaaagatacttgcacatgcatgtttataacagcacaatttgcaattgcaaaaatatggaaccagcccaaatgcctatcaatcaatgagtggataaagaaattgtggtatgtatatataccatgggacactactcagctataagaaggaagaaaataatggcatttgcagcaacgtgaatggaattggagactatcattctaagtgaagtcactcaggaatgcaaaaccaaacatcgttatgttctcactcaagtgggagctaagctatgaggatgcaaaggcatagaatgatacaatgaaatttgaggatgtgtgggaaagtgtgggaggagagtgagagataaaagactacacgttgggtacagtgtacactgctcaggtgatgggtgcaccaaaatctcagaaatcaccactaaagaacttattcatgagaccaaacaccacctgtcacccgtgcccccccccaaaaaaaatatatatatatagaaagaaagaaggaaagaagggagggagggagggagggaaggagaaagaaagaaaggaaagaaagaaaagaaagaaagaaaaagaaagaaagaaagaaagaaagagcaagaaagaaagaaaagaaagaaaagaaaaaggcatttataaagggagaatcaagattaggaactaaaatgacgacaaaaatttgaacagccctcgcactgtgtgtcctattttccctccaatctatatagcagtccgtattagtcaccacttgagctctagtgtttaaggtccagttaattctctctgactcacttagagaaggaagtgttagttcatgcagcatatcattacatgatagaaaaaggtagtaatgtatgaactaaaaggactatgatggcgatatttaatttcctttgtccattcattctacaaaatgtttagtacctactgtgtgttacattgaggtctcattgctgaatacacagtgttaacaaactactattctcacagggagtacagtccagtagggagacagctgttaaaggcatggtcccccaaatatactaagaattacaaattgtgatgagctttatgtaggaaaagagcatgatgtgatgagtgggatcaacaagaggtcataagtcagattgcaaggtctgggaaggcctctttcaggaatatttaaactgaaacctgaaggaaaattgaaaaatttgccagggaaagagtgcttgtcaaagctgtgctgaggcttgctcaactctgtcacagctaccctctcgtgaatggctaaactctttctattggtgagatctaccactgcaaggtcaagttgtgacaactgagtctcctagcatatatttgtttttactacttggtgcctctgtttattgaatcacactgtgctgcatgctgctgggagaatactatgatgtcttcctgaagataaaaatgctgacttagagcagtggcttccaaatctattagagagcaagatgatactgcaatatgtatgcatatttagttttaatctaaaagataattaatctttattaatatttatgaattggcatagtatgtgtagacaatttgtaaataaatctacgtcatctggggatatgtcgatatttttactgataggtgtgcacaatcaagtttggagatcacttgcttaaagtaagcaaaggatagccagggatcactgcacagagtaagcagagcccaaactctccaatcccactctcacattttcattagggcatctctttcatagcctagcttagattcctctctcgtaaccagagaaactaccttctctgataacactgattcatcctcagatttttcatatccctgacagcttatagcactccctgtctgattcaaatattttgctatgttagtaatactgccttatattgctttctggtgttttcatctgcagtgatcctgtctttcaaagaagatctaagttgttctggtgctagattgaaatccagctcacttttatctgtccgtagtgctgagaaaataaaaggtactcggtgagcacttctggactacatctcctaggaccgtgccattcaaagtgtgaccaaaagtccagcagcatcagcatcacttggaagcttgttaaagcacatcaaaatttgcactgttctccctctctttcttccacaattctcccatttctcctaaaggcccatcatattaaaccagtgcctcttaaactttaatgtgcatgaattatctggggggaatcctgttaaaatgaagattctgattcagtaggtctagacgagacccaagattctgtattttaataagttcccaggttattctggtgattgtgaatggtgcttacacctttagatttcaggctctaaaactatgctgcctgatatggtagccctagccacatggagggattgagcacatgacacacgggatttcaaagactaagtgtggaagaaagaatataaaatatctcattaataagtttaaatattgattatatgttgcatggataatattttgaatacattgggttaaataaaacatagtatcacatttaatttcatctgtttctttttacattgttaatcgaagctactagaaaatctaaaattatatatgtggtcacattatatttttattggacaatgtggctgtagacactcctctggtactcttaaatacgaatatatgaaggtagtgttatctattgagaatctattgagaattctttgagcatgaatctcaaattcatgctgctaaagttgcaccagtttagggatagctgaaaaaaactgtaattatacatcacaaaaatatccttagaaagattttctttctcatggaagtatatacactataaatacaacttctattactcaaaatattgagatttttgtcaacatttcagatttctgtgtgtatatgtgattcataatgtaggcctcctcctacatggatgaatatacatataagcattagattagtcatctgtaattaacttcttgacaaatatggataatgggtgagaaagaatgctattatatccaaagtgtaacgtaattgttccatagttcttgatattatgctctattttttcagtcttttttctgcttgcatttcagttttagaagtttctattgacatatcatcaaactcactgatttttttcttggctgtgtccagtctactgatgagcccatcaaaggcattatttatttatattacagtgtttttgatttctagtatttttaaattttttcttagaatgtccatctctgtttatattactcaagtgttcttgaatgtggtctactttttccattggagtcctttcatgttaatcatagttattaaaccctcgattttccttatgggtaggtgtaggaacagcagtggctccagagttgctaaagagagggtcatctgatcagaagagaatgggtagagacttattttaaaattgtattagcattgcaagcccattggtttttacttgtattggagctggatgaaatagtgggtaaaataagacataaaatatgaataggaggcagctaggcagggaagggggaagagtatttgctaagtacatgttttgattatctattaccatataacaaacctcacctccccaatattccgtggtacaaaacaacactcttctatttacagttatggattctatgggtcaggaattggggcagggcattatagggagaatgttatatttttctaaaatgtctgggttttcatcaggaaagactcaactggcttaagaactggtggctggaatcatctggtagattcttgccttacatatctgtgatgactcaatggctgggctcagcaggactgttgaatagagatcttacaaatggcttcttcatgtggcttgtacttcccagagaaaagtgactggggttccaagagagaacatccaagagagagcatcccaagaaagagcattcagtgagtgatcatttcacaaatttaaggaagaaactgcaaggcttcctctgatctacccttggaagtcacatagcattacttcatctacttctattattggaagaaagtcactaaagacagcccatattcaaggtgggaattagattccatccctcaatggggtagtggcaaggtcatatatcagaagaatgtgtaggatggaagatgttgtagccatctttggaaaattcagcccatcacatcatactaacagagtgtggtgtgtttgggtaacagaaagttaattctgactggagcataatgtcaccctgaaagactttattttacacttacttttccaggggctatattctagggaacgacattcctttgattctataataggcaacctggtgtattagagagttcatgggctgtggaattaaaaaaaaaaaaacccctgggttaacttactttattttctgtattcattgcacaactatttattgttccttcaaatgttgtttttaacatatttatgcagagaataacaacgagcttatgggttgcattcaatccttggcttgactggagtccattatcctttagtaaaaacacctagtggagagaggtacatttgtgtctacagttagaaaaaaggtaaaagtgttttgaaaatctttggtaacaatggagtaaaaagcccaaagttgatgacagtgatctaggcaaggctgggcctctttaggtattcatcttacttggtgtgttcctcttacttttctcttggtgtgtgtttcttcacatctttttatgtcagttatatgtaaatggttgtgtttgagtctttacaaaggtttctatgtatttctatgagtcattttgtgggtgtgtccctcatatgctctgtggcagattgaattttctaagatgaccaaaaaatatctcccatcctgcacacttatctacaatgtaatgtttgcgtttcttccacggagagatgaggtttatggtcccttttttcaaatcttaatggacttgttactatggtaaaagtgatattatatgactttttaagctacgttattaaaggtgatatgcccatctggccttcttggggcatgtgctcttgggagccagtcacaatgctgtgaagaatcccagctcacgtggagaggtcatgtgtaagggttccagctgatagccagcatcaacaaccagacatgtgagtgagcaagacttcagatgattccagcccccagctactgagtcatcatcatactttgaactttcccaagcaacagtgaatagaggagagatgagttgtccttgctgagcccttcccaaactgcaaattcatgagtaaaataaatgattgcagttgatctgtaccactacattttggcatgatttgttgtgcagaagtagatgacatacattttctgattctctctgtatgcctttctccatcttgatccctgtattttattgtctaactcttttccatctatatctctgatccttttttcttcttcttcctgcctgtctttagttctctaatttctcttataatttcttgccttttatttcttaacctgctgtaatatacaagagagatagaattttatatttggatagtattttgtgctcccttttgctaatttttaaagcacaggagtggaatatgtaatcttcatttcattctaaaacacaataaaaataaagttactgcttctaacgaaagcttttatttttttgccttctgagtgtccatggccctcacaggaatattctctatcctgcctctggtgcttcagaacggatgaatgtgtggataatgatttcctggtgaatatagttttcatttttataactttatttttcagcccttgaaaaatggtattaatatactatggtggtgttgtatttcttaaaaatatgttgctgaactcttcctttctaattctgatagactaaaaaacctgccctttggaaagtgaaggagataaatattttctttcaatggttcttgaggtaagtaagttctcctagccctaggataaaggctgaaggatacaacttcagagagcttgtaataaggcagcctctgacctgaaatctggagggctgagttgagaatatttcgagtccttcccatgtgtgatgttttggaatttcttattttcatgtctttatattaccatcagttttgcaaaaactattcaaatgcaaaactcaaatatgtcaccatattcattttactcctttatatgaaaaatcaattactttctacctgattctttacttttaattctataccatgcaaccatgtacctttttataataatccatcctctagagtagaagccagtatcactgctgaatggtctccacgacccggacacatcccaggcattcatcacatttgtgaatcctacttcctaaatatctctccctcctacttttgttggaggtatcatggtgtagtaatgaaaataacaaggcttttgggaccagttagccttgggcttagtcttgggtctaacactgtgacctggggtgagcttgacctggggtgaaattgattctcaatttctatatctataaattggggattcatagtgtctttgtgatgaatgagataagagtgtcaaagtatttagaacataatgaatccttgataaatgttggtttccctcttcagatcctcattctctgtctccaaggctatttcattaaacccttatcaggattgctgctttgttaatttcttttgttcataattaagagctgacttctcattatggctttcaagatcctttacattttggcaactgttttggttctctattgtggtataggaagcaaatccaaaccttagtggctttaaataacaaccttttaattatttctcacaattctgtgggttggatgattctaccggtttctcctgggatctctcaagtcatatggcaactggggctggaataaccaatatgactgaactcatatatttggcatcttggcttggatggttacactcagcagagaccctaggactttagggtctctccttactcaacctctctatgtggtatcttcagcaggttaacaaaactccttatgtagtattttagggctgccaaaagtgtaaaacccaagaatctaggtcttcttaaagctgaaagcctgagctgcacaggtcacttccattgcattttactggctacaaaggaataattaagctagcctagattcactgtgggagaggactacacaaaagatgggttatggggaggcaggactgactggaggccatcttgggagaccagttaccaagtgacaaattccttttatagtttcatcttccacatttcttttcagtgtattcttcactccaagtatacaaaaccaaggattgtgtgtgtgtgtgtgtgtgtgtgtgtgtatgtgtgtgcgtgtgtgtgtgttacgaggtgaggtgggagagaaaagttgtaggggtactgtgctttgcacatcccattgtctgaaatgctaattctcttcttatatagatataaaacttctcctcatactttttgacagtgtattagtccgttttcatgctgctgataaagacatacctgtgactgggcaatttataaaagaaagaggttttatggacttacagttccatgtggctggggaagcctcataatcatggcagaaggaggagcaagtcacgtcttacatggatggcaacaggcaaaaagagagcttgtgcagggaaattccctcttatagaaccatcagatctcatgagacttattcactatcacaagaacagcaagggaaagacctgcccctatgattcagttacctcccaccaggtcccttccacaacatgtagaattcaagatgagatttgagtgagaacacagccaagccatatcagacagctaaaatgtttacctcatttgtgaggccctccttaactcccacaaagactcattccttctacttgtctggatatattttatattagcacacagcccttatcagtccctatattgttcgaatctttctctcagactttatctgagcatcttaaaggcatgactgacttttttattgtcctatattcagtgtcttagtctgggttctccccatagcaaacacagaggcaaggctttgaatgcaagtctgttatttagaagggggttccaagaagctctatgaggaagtgggaactgagacaaggaagggaaggaagacagtgcaaaatgtgttaataagcatgttactgctgtgggcaactggggttcacttctcctggggacttctgggaaactataattctgggaaactagaacttttctcagacttgttctaccacagggtgaggaagctggaatgtttacctaccaactcccatccttcatttattgaagggattgagggctgctccctggagcattagttcctggcatgtgggcctgccctgtactccagcgtagcctgaaaaaaaccctaaggtggaaagtcaagtagtttccgaagaaagccaatattgtgtaaggaaggctgtgacaagaacaaaggagggggcggatggggacacttaaagcatctgtaacaaccagtgtccacagttttttttttttttttgagatggagccttactctgtcattcaggctggagtgcagtggcacggtctcggctcagtgcaacctctgcctctcaggctcaaacgatcgtcccacctcaggctcccaagtagctgggatcacagatgcatgccaccacacccagcttatatatatatatttgtatttttggtagagatggagtgtcaccacgctgcctaggctggtctcaaactcctgagctcaagcaatctgcacacctctgccgccccaaatgcctggattacagacataagccaccatgccctgccaatatttaatcaataaatgttggtttaatgacaccagtgaatgagtgaagcttgtagatattttgtttttgtatttgtggataaggcacaaataataaaaaatagaaatgccttttttgaaattaaaaaaaattcattagaatgtatgtctttacgaatcagaatttatgatacccaggccaggtgcgctggctcatgcctgtaatcccagcgctttgggaggctaaggcgggtgggttacttgaagccaggagttcgagaccagcctggccaacatagtgacaccccatctctattaaaaatacaaaaatacaaaaaaaaaaaaaaatagctgggtgtggtggcgcgcatacctgtaatcccagctactcaggaggctgaggcacaagaattgtttgaacccaggaggcagaggttgcagtgagctgagatcgcccactccagcctgggcgacagagtgagactctgtctcaaggaaaaaaaaaaaaaagaatttgtgatatctactaatatatttaatattcttttattattgtcctcttctgaatactttcattgttcctggtaaaaatatcccatacattacgagaacattatgcagtatctaattgcaatgctttgcttttgaacatactgtgtataaaatggtgtcaggcctctgagttgaagctcagccattgtaacccctgtgacctgcatgtatgtgtccagatggcctgcaggaaccaagaagtctggggcagccaaaaaccacaaagaagtaaaacagccagtttctgccttaactaatgaaccaacattacaccattctactattgtggcttgaccctgccatactttgatcagtgacttggtgacatccttcttctggacaatgagtcttatgatctccccaccgcgcaccttgtgacctcctcctctgccaacaatagataaccgccttttactgtaattttccattacctacccaactcctataaagcaaccccttccccatctcccttcgctgactctctctttggactcagcccacttgcacccaagtgaaataaacagccttgttgctcacacaaagcctgttggtggtctcttcataaggacgcgcttgacaaatgggatccatctaacctacaggaagaggtttcaggaatttgggcaagttgcattggatggggaactgtatgaagattttggcacagtttgcattaatacatttcctgatgcatcattgtttatgttagttgtaaattattctttcattgataaatttagttctgtcattgagagccttctgcaaagattctattatgtttaattttactttatttagaataatttgcttcagatccgttgtccagaacctgcaaaattactttaaaatttaaaacaaaaattcaaaagttaattcagatacagtggaaccctcagaaaacagtgatgctgagaaatgagcatatttattaatgttcagacaagtacgcctctctggactttttaacacagttgtgatgcgacttgacatgaattaatttgtgcagtaatgaggcatctttaaaagaagtgagcctctcaaacctgggtgaatattagaattacctagatgcttgtcataaatataggtttctggaacctatccttctgaaatatatatttaatatgcaaaccagatcagtctgaagatcttccaggtttgagaaatgctatctaaaaggcatgcctgaatgacatttaatctgcctagattattagctccttctgctacaagtaggccatgttttatattgatttggttttccctgtagcatcagtacaatgttgagtagatagtgaaccatcagtaaatacttggtaacaactgttttaaggcccacctatttgcacttgacttgattagtggggattgttgtcttgcgggatttgcaatttggcatctcagtgcgatgttgaatcagttccttcgctattcaacagaattatttaaatcatttagtcaagggtaatgaaaggaagctaccttatattaagtatgttccattgacagatactttctgtaggttatctcatttaattctcacaacaatcctacgaggaggtacttatcctcattctgtaaataaggatacagtttagggaagggtaagtaacttgcttaaagttatatagcaagtaagtgatacagctgggattagagtccaagtttatccaatcccaacattcatgcttttttcaatttgcaaaaagactcctttcaaggcatcttccaagcaaaagtcatatacaaaacatgctcaattagtggtatgggaaagagggggatcaaagttaggttcttcgttagccagatttgattctgagctacagggagaaatacatactgaatttatgaaaaaaaccaacaactgggtttttaaaaaatgatcaggataactgtagttgagaggaggagtgagagttttcggtggctacaataaatagaattctatgttcaagagggatttagaaaggtcttaagagggagtactgcaagggttgacacaagaagaggtcaagatatatatggggatttcatttctattgcgggtcaaggtgagaatattttcaagtagtatcaaagggaacatgaaaagtagtctcagtgataagagaaatgtgagaattgccaggcatggtccattccaagactgctggcttaggagcctctagggataaaaggaattaggaccggttatgcttaaattccatcctgcaaattgtcctgaaacagagaaggctgtcaaagtcaggcaggtcatccgataagagaccaatgtacgtgccaaggggtgtgcttgagtcatatattatcacagccggagtcacatccttagttgctgttcatagtgacaaatctcagtgtaaagttagcaaagaaccaagtgaattcttgctcaaaagggtgggcagaatgtctagaagctttaaagaatgtcaaaggcatattccacttcatattcctcttactatttataatgactatcacttacattttatagcaacattggtccctttcttcctctctcacctccttcccgccccatgatttttttttctttttctcttatgtaagagaaaaatccatgtctaatgacaaattttcctctaaaggctcaaaagagtatgtgatctgttttataaatgaattaaatcactttcatcacaataatatgatttctaaggggaactttcaggtacctaaaagtgatattttgagttatttttggatcaggcttttagacatgataaaaattggcctttcatgattacctcagctgatccatgctactcttcaggagaaattgaaaattccagcttgataccgacgatgactagttcattggcatcttacttgaacaaatgtaggttaaatttggaaaggatacactctagtaataaaactgtcagaagaccagcttttgatggtctaaagcttccacagttggtgaaatatttgcaagggtactggaaatacatgacaattaattttcttaaggaaagaatttaagtcacatctttccttagggcagacatagactgccacttcaggaggggacatattaggacctgttgggtacatgatgttttctgcttattcctagcttgtataaacacatcttgtaaattattttacaagatgaatgacacaagctgggcttgtgtcaagcaacagaagtcaaaacatatgacagatcaatataccattatcttgcctgactttattagaggtcaaagattacagatcactagtaatgaaagggacctagagattactgcattatgaggaaggctggtagtggtttagggtcgcagctttggaaccagactacttcagttcctatcctggttctaccacttactacctgtgtcacctcattcaaattatccaaccaccttgtgcctgagttttcttctctgtaaaatggtaagaggaataatagtcctcatctcattgagtgtcatgaagtttatatgagttaatatctgtaaagcactcagaatggtgccttatgtgtaataaggccatatatgtcttttctattatcattacctcaagacctcagtttacattgaagaatctgagacttctgaatgactgtatgtaaggccacagagtgtgggccagaagtcagctctgctcattccaaactcagggctttttgctctgtcatgatgccttgctatggaaataaacaatttcagtaagtcccaaggaattggaatttcattgaatgcagtattttttagggtaaaacccaaaaataatcagtgatacttatgactattgtcaagaagtatatattaattcttcggccttaggcattgttgcaaatatattggtgcccctgtatttcactgctcactggatcagtgcttgctatgagcatccttctgtgggcacttgtgactttctgctcatggttttttttttttttcccagagcgggggctttgtgtgcacaaagcagaaatattcaggagttaatgctccctttgggacaggcccccccccaaacaatgatggaagggatttgaagagtaaacaccccgtcttcttgtccctcatatgatacaacactgaggattattctatgcactctttccgaagtccccagcaggatcaagcttcaagagctcatggcagacacttgcttactgataacacgccttggattggcagctgcttcttttagtttcactgcccttctcttctactggtgtttcctgggatcacctctcaagtaaactacatacactcaaatcctcatctcagggtctgcttgacctcagtgaatgatgattagaactaagcaaaagatctaggtactctctgatttggggatagacacacccaaattattgtttagtattctggaagacgcaaaaaataagccagctgtgagtctccttagaaaaaatggacatgtttttagggtaccttttttccatacataacaatctgggcctacttagaaatataaagttctctgaaacttttaaaccctgaaggaaactggaaatgtttgaacaaataaaaatacttacatagcttatataatttttaacacccttcacagatctaaagtcactttgttaatttaggaacataaaaatgcattatgtataacttggttggctcctaaaagtatcatgtttgatatcttgagagatgtgaaggcctgaaaaatttgaggggcaaaaagaatattgtgtaaaggaatcttgaaatgccatgattaaataaaattccaagattattctataagctggtcagttatagtctgttggtctaagtgagagcattcctcctgccctggaattgctataagtaggagtttaattttccgggaaatttgggggctatatctgtggggttgagtcaccagagttctggggtttggcaaatgacctgcaattttgatttggggtgctttgggactgagttgtccaatagtgatgcccaaagagtgagcccttgacattccctatgcatctcagcacactttctggcacccctagcattcataaatatgaatacaatgttgagtaaagaaaagacaaccatgttgagatgcaggtgctgagtagtctgttagacccagacgcgagctaaaggacttgggtcctcacaccacagatggaagtatacaactatattcctttgcaaaacctaggatgaaatcagctaacaaatgatactcccctggccacagggattagtttacatgtgatctttttagctcagtggtcaaagtttttgtggagtggttgaaggtagctttctgtcagatgtaaacaaagaaacatgtgattttgattgttactggaaatcaccctttgactcagcctgaaaaagaggacaggcagacctgaaacatttaccttaaatttaggagagaagtagagccacaggcgtgatcaaactgtatctgaaactgacactatctatggtcttctcagttacacaagccaccaaattctccttagtgttttagcctgtttaggtaagaatttatttctcttaccagaaggcatccttatggatccatttagatattataggaatgtgaatactagaatttattctttaaaaatgatttaatataaattttgctttaactataatctagctcaataaactgtgctctcaggctccattttatagatttgtctagagttgatgttaagtatggctgagaattctgagcaccattaggaattgagcagaggataaaatccaggggtcttcctttttacaacaaataagtgttagtctcgctctgtcacccaagatggagtgcagtggcgcgatcttggctcaccgccagctccgcctcacaggttcacaccattctcctgccccggtctcccaagtagctgggattacaggcacccgccaccacgcccggctaattttttgtatttttagtagagacggggtttcaccgtgttagccaggatggtcttgatctcctgacctcgtaatccgtccacctcggcctcccaaagtcctgggattacaggcgtgagccaccgcgtttggcctattgtgtatttttaatgtatgcagcatgatgttatgagatatagatagtcaaatgattactatagtaaagcaaattaacatacccatcatctcacgtttacccattatttttgtctgtgtgaggcaagactgctacaatctactcagcaaaaattctgattataatacactatcattagctatagtcctcatgttacaggggccttcttaaagtggaggttcagtataagtaccatagaagaggatgtggtcttgcaatcacatttcacaaaactaattggccacattccaatttgaataaacaaattagaataaacaattccacctggcttagatacctattttagttgggcaactggctgttctcttggcatgtagcagtgagcattcaacagctggtgctccctcacccatggggcctttcttttcagaagataattatttcagagactgacaaagaactgagatctgagctgggatcattaagtgccaagaatgtaccacagtcttagcgtatcactattttaaataatgatgggagtttataaaatgaaagtattttctcttcaagatacactgtatgcatttttccctaaaactgaggaacataatattaaaagacttcccctttaaatattgagaaagtacttacatttattgagtctgaccctgtgctcatgatggagaattttctcttggtgagatatcaacaattcataggatacaaaagaaagtgaaatgtggtttggccatatgcacctgttttttaacttatggagtgtttttcattttctcaggctctctgcctggaacactcaccacaccccaaagcacacatggcaaacttgtacacatctcatcttatcgttcttcctccaggaaatctttaaccactatcacccacccacccagtaaaggttacgtacatagcattcagtactagatcatcaaagcatttaccgtaccctttggtaagtgcctctttacttgtctttatccccaactgtgtcagacagactttaatgcgcccccccccccccacgatccccatctcccggtgttgacactcctatatatttttttcttcttgatcttgggatctgtgacttggttcctactgatggaatatgaaaaacatgatgggatgtcactccaatgactgggttgcataatgtaaaacactgtcttaatactagactcactctagggactctccttgctggttttgaagaacccagatgccatgactcctaaagctgcaagaaaatgaatcctgggccgggcgcagcggctcacgcctgtaatcccagcactttaggaggctgaggcgggcggatcacgaggtcaggagatcaagaccatcctggctaacacggtgaaaccccatctctactaaaaaaaataaaaataaaaataaatacaaaaaattagccaggcgtggtggcgggcgcctggagtcccagctactcggaaggctgaggcaggagaatggcgtgaacccaggaggcagagcttgcagcatgcagcagtgagcaagattgcgccactgcactccagcctgcgcgatgaagctcgactccgtctcaaaaaagaaaaaaaaaaaagaaaagaaaatgaattctgccaatggcctgagtgagcttggatgtggactctcagttgagcctacagatgagaattcagctctggctgacagcttgattgcagccttgtgagacaataaggaaaagaccaagttaaattgtgcctgcactcctgacccacagaaactgtgagatagcaaatgaatcttgttttaagccactgagtttgtggtaatttgttctgcagaatagaaaactaacacaccaattaatgaacaaagtcattaagaatagggaaaatatctgggttttttgaggtcatgacctccaaggcctagcacagtgactggtaccttgttggtaaatatctgttgaatatattataaaaatttgtttaatatataaatatatgttaaaaataattattgggttgggcacagcggctcacacctgtaattgtagcactttgggaagctgaggcaggaggacttcttgagctcaggagtttcagaccagcctgggaaacatggtgagacctcatctgtactaaaaatacaaaaaattagccaggcatgttggcccacatgtgtagtcccagctactcaggaggctgaggtgggagaatcacttgactctgggaaatggaggctgtggtgggaggatcgcttgactctgggaaatggaggctgcagtgagctatcatcatgccactgcactccagcctgtgtgaacaagaccctgtttcaaaaaacagaaaaatgtacatatatatatacatatatatatatatacatatatatatacatatatatatatatacatatatatatacacacacacacatatatatatatatatatatatatatatatatataaaataatttttgtgtgccaaaataaagtctgttcttcgcattagagagtaggagtctcttctgggtgggtttgcctctgtgctttggcattagacacttctcattactttagggctcacttgatttttcttcttgccagctcagcttctggggcttctggacatgtcatcctatgatctaggacaattttaatttcaatttttaacttaatttgcccttctcccttcactccctagcacctcaaatatcaaaggaagatatcttagaataggatataggatagagaacagaatatttctctttgggtgaaaagagatggagaaataacttcagcaaaagatgctgatcagctacattggtgtggtgagggtaagtctgtaattgttaagtgacatcctaaaagtgctggatgcctaaaagtattggatgcctttatctggtactatgcttattacctgggtaacaaatggggatgtggaagtttgggatgaggagaggaaaaataaagcatattctgaagaccaatactacttctccatgaccctttctatctgcagatttgctggtcttctagtgattccaatttcctgtggacagatctctaccatgaattttcacatcatacatattatttatatgtcattttcttctactaaattggaaactccaagagagcagggtcttgactttttttttataattatgcaaacaaacattccttgagcattgccttttcctcaggcatagtactaggtgctttacttgtatcatttcatcttctctttacaacacacccatgaggtaggtcctattcttgttctcattttacagatgggaatttgaggttgaaaaagctaagtttcaagtcacactgtcaataattggtagaaccaggatctctgtatccccagcatgtagtgcaatgactagcactaggtaggtatccaaaagtgcctctgaagtcactgtgtaaagcccaggctgagaccaactagggggaatgtcctaacttcaacatttcggaatccaccagtgttttctaaagcaagcttctttgtttgggggattacaataggaagcctaactctggttatgcagcaggaagcgccttgctttgaggtctggtggcctactaatccactgataccaaacatttggaaaacatgagagagaatggccttagaactttcacctgtagggcactattcacaagcgcaaagacatagaatcaacctagatgtccatcaacggtggattggatgaataaaatgtgcacgtatacaccatggaatactatgctgccatagaaaagaacaaaactatgtcctttgcagcaacatgaatgtagctggaggccattatcctaagtgaattaatgcaggaacagaaaaccaaatgctgcatgttctcacttataagtgggagctaaacattgagtactcacagacgtaaagatgggaacagtaaacaccagggcctacttgagggtggagggtgggaggaggataaggattcaaaaactacatatctggtactaggcttatttcctgggtaacaaaataatgtgtacaccaaacccccatgacatgcaatttacccatgtaacaaacctgcacatgtatcccctgaacctaaaataaaagttggaagggaaaaaaataatttccacctataggagtaatttctgttctcagtatccagttaaacattttcttgttaatgctcatttttctcgagaagatgatctgctcatctagtgcactgttctctgagtgagtgaccacactgagctcttcatgattagcttggtaatgtgaatggagacaagagtgggggaaagatggctggacagcacactttgcaattaggcctcttaagctggaaaaccggttatcagccatcataatctttcacaattgcctctgccctttaagatatgaggatgacattattttttacgttactgggtgttgtggaatgatttcaccctctggaaatgtctattgagctgctgcttgaaatcattttatgacaaatttttaaatggagtgcttaaaaatattaaattcctttttccttttcttctttcctccttttcctccttatttcctcccttcttccttttttcccattcctttccttcttgattccctccctcttcctttctttccttctccagatacttactgagcacctactaggtgctggggttaaagagttacacaaggcttgcaatatgccgtatctcatggagcttataaagtatgtagggggaatttacagaattaattaggaaaataaagtaataaacaaaaatatccaattttaaataatgtaataaagagaaagtagggtgacacgatagagattagtgagtgaattccatgggttgagtgaacagaaaaggtcttttcatgagattttaagctaggacaagaaagactcagcagtgctgatgtggtggagaactgcaggcagagaaaatagttaatgcaaagcttccaaggtgggaataagctttgtgggtttaagggacagcagtgaggtcaccataactatgatggagcaggaggttatagatatgggcaagaagcagatcatgtagggccttgtaagccatggtaaagagttggtacgttactctaaataccaaagagaggaatgaaatggttttaagtagatgaatgataatggtctcattattacaaagaagtattactgggtgataaacatatatgtttatattaagcttttttctgcttgcagttctgaaatatttcaaagttttaaagacaattgttattactgcatccaaaattaattgttagaggacaagaatggaggtagaggaatgagacaggaggccattgtatatcaggtgagagataaaggtggttagaactagtgtgacagcacgtgagaaagatagaagcagacaggctcaggttgtgttttgaaggttgagttgatgaaacttgccgatgtttgaatagagagcatgagagaaaaataggaatcaaagataaactttgtttaagaaattggttgaaaaaaatggtgtcatttcccgaaatgggaaaaatttgggaggtggggcaggtttttgtagtggtagggtgacgaaaagtgctcttttggccatcttaaacatgagatgcctatcagatcttcaagtgaagatgtaagagtcagaaaaataggctggaaatgaagctctgcagtcatcagcttatcaatagtctttaagaccatgggtgggatgggatcacctagttagaggacagatagagaagggaaaggagcccaagagcgaggcacagaatgctccaatatggaagtcaaagagaagaggaaaaactagcaaaggagactggccagtgagatagagagatgatatactttggatatttgtcccctccaaagctcatgttgaaatttgatccccgatgttggaggtggggtctggtgagagatgactggatcatgggggcagatccctcacgaagggcttggtgtcattcgtatgaggaagtgagttctcattcttagttcccacaagattttgtttttgaaaagagcctggtacctcctcctctctcttgctccctctctttccatgtgatgccaaccccctttttccttccccttctgccatgattggaggctcaatgaagccctcaccagaagcagatgctcgtgcatgcattttgtaaggcctgcagaaccaacagccaaacaaacctcctttctttataaggtaaccagcttcaagtattcctctatagctgcacggaacagactaatacaagggacaattgggagagtgtaatcctgagaaaaccaagagagaaaaagatttcaagtaggagggcatagtcaactttatctaaagcacccgtttttaaacatttttgtattgtagcatctttcataggctgtggaatcctatggaccacttctcaaaaaatgtttttaaatgaataaaataaaatacataggattacacaggaaactaattacattgcagttacaaatgtcaaaatattaacacacaaatttgatgctagtatttgtgctttttattaatatataatatatattaaatatattttattaatatataaaatatataaaaaatagtccagacctagcagcagatctgaactattgaactctctaagtagtgatgagcagaaatgacattttgagatatgagatatctgcaacatcttcaatataatatatatgatgtactatgaaaaagtaatatgtataatataatatgaaaatacgtatgatttgtgacagagccactgtgatttgttgactatgtttaaaactcaaggaaatgctaacttgcagttagtgattagtgaaaacagagatatatttttcctatgcaagttcagattctctgatttcaaaaccactggtttaatgttaagaggtaaatctttagaaatgggactcagtgatatggattctcctaaatggtgacttattttgctgtacttgcttaagcttgagcaataaccttaggctcgtcaatgttctacctcttactgttagacaatgacattaaaagggcataggagcaatgacagagggagtgggtggagtggggaggggaatgctgaatattcttttctgtagttacttatgttcaagaacattaatattcataaagatgtctaatattaaaacagatttggaaatgaattcattagggcagaaaacatttaaatctgtctctactcccgttgtttgatattcagaatactttatagggaaggatagacactcccataaaggttctccctttgttctttttttctgtctattgcctccttgaaagttctagaatattggccaggcacggtggctcatgcctgtaatcccggcactttgggaggctgaggcgcgtagatcacaaggtcgggagttcaagaccagcctgaccaacatggtgaaaccccgtctctactaaaaatacaaaaattggctgggcatgatggcacacgcctgtaatcccagctactcaggagactgaggcaggagaatcgcttgaacccaggaggtggagattgcagtgagccgagatcacaccactgcactctagcctgggtgacaaagtgagactctgtctcaaaaaaaaaaaaaaaaaaaagaaagaaagttctagaatatctattatattcctctttccctttaattatacactgatatacaaaatatacataacttggactctttaaaacacaatgcccaatttatgaatatgctgttaattttcaaatttcaaaggcagattgatgctcaaaaatatttgtttgggcctggcgcggtggctcacacctgtaatcccagcactttgggaggctgagacgggcggatcacgaggtcaggagatcgagaccatcctggctaacgcggtgaaactccgtctctactaaaaatacaaaaaattagccgggcgtggcggtgggcgcctgtagtcccagctgctccagagcctgaggcaggagaatggcgtgaacccgggaggcggagcttgcagtgagccgaaatctcgccactgcactccagcctgggcgaaagagcgagactccgtctcaaaaaagaaaaaaaatttgtttgttgactgctagatagaaatagtgtacttaattccctgctcctcctcataccttttcactagagttctaaaagtctaaatatttatacctgtattcaacacatcaattccatgatgaacaaactttcatagtcgttttgcttgcatgtgtgcgagggttatattggggttgcattatagtgcaggggttggcaaaactggcaggtggcctgtttttctttttaaaaaatatttataaatgaaaaataaataaataaatgaaatacatgaaaaagaaaacttgtaagcacagtacaaggaactcccatatactcttttcccagattcaccagttgtttatattgtgcttctctctctctctttccacacacacacacacacacacacacacacacacacacacacacacacacagagagttgggccttcatatccatgggctcaccatctctggattcaaccagctgtggataaaaaatattcgaaaaaaagaaaggatggttgcatctgtactgaacacgtacagagtttttccttctcattcttccccaaacaatacagtataacaactttttccatagcatttatgttatattaggtattataagtaatagagattatttaaagtatatgggaggatgtgcataggttatatacaaatatgccattttatataagcgacttgagcatctgcagattttggtttatgtgggaggtccctggaacccatcctctgtgggtaccgagggacgactgtatacacaaacacatatacgctcagccacccccacagattatatataatctctcaatccatctcatattagttcatacttatactctcaattccaactcagctccacagggtgtatttttgtatcctctgtttctatacgtgtaagtcccccaatagtgagacatttagcttctatcatcctcaacatatttactcatttgctgaagctgaaaatatacagaagatagtttcaaaatttctcatccatgccactgtacaaaccttgtgtggcctgtttttgtacagccagcaagccaagaacactttttacacttgtatagggttgtcaaagcaaaacaaatgaaaaaacaaagaagaatatccagctgacaccttatgtggcctgcaaaacctgaactattccctctcttgtcctttacagaaaaaagtttgctgatccctgcgcagtggctcctgggggtgtgtgcatgtgcacacacatttacacgactatgcttaaggaagccttctcagctcccttctttaaatgatagattttgtccccttgactactgtgttcgacaagtgatcagaccaggccagtcctaggatgcaagccccctaacaactatggttggtccaagaggcgagcatgtgaaacaatcagaggcctagtgcccttcccatagaattgatatgtaaatattgggaaaaagttccttctcttttcactgaagttgctaaactgacatgaggtaagcctggacatgttgttgaacatcatagaagagatctgcagaaggagagattagggccaacacacagaagaaagagggcctgatcgatggagggtaagaaggcacagaccatggtatctgagacctgatgtttgaggccagatccattcttctctctgtgttatctgagtcaggaatttccctttgttgtttaaacttatttgggttgtaattctatcagttgtaagcaaaatacctttttgtaattcaaattcatcacagtgcttccaaaagttcaataaaaaaactcaactttttctttcttgcttaattggaaagctacaataataacatatattactaccaaatattgaacactcaacattctaagcacggggctggtcgttttataatagcattatgaaatatgtattattgtgccacattatagaggagggagctcagagagtttaagtaatttgattaagattgctcagctaagtaggtggcagagctgagaaaacattcacattctttgtgactccaaatttcacataaattttattgtgatcatagaatttaagtaaaagacgaaataggaccttatcatgctcttcccttttaacacagcataacaataagtcagtacctatttccacattggcagttttggatttaaatggagtggcattgttttctcgttgcatataaatacaaaaacttaaaacacatgtcaacaacttggctgttaatgctttagggactcagaacatcataatgatgtatacagtggaccgtgccccactatttggctgagaaatacatacatttgaaaatgtagggatggtttctaaccaactgtctttgatcaggttccccagaacctgaggcaaggattaagcactggtacttcattggggaggtgcaaacccaggccactgaggaagaaaggggagccgtgcaaagtcatgtgtgatggtgcatcacaatgagccagaaaaagacaaagcagattgcttgacagatgtgtccacttagtcaggatatctgtggatgtctgcatacaagctatttggataaaccgtgcctacaaacaatccacggaaggaaggatggagagagaatttatgtgcctggctgtctcatatcctgtttgccactggttaagagtttgtccaaaagggagtgaactccctacactcctttttttttttttttttttttttttttttttttgagacggagtctctctttgccacccaggctggactgcagtggtgcgatctcggctcactgcaagctctgcctcccgggttcacaccgttctcctgcctcagcctcccgagcagctgagattacaggcacccgccaccacacccggctaattttttttgtatttttagtagagacggggtttcaccgtgttagccaggatggtctcgatctcctgacctcgtgatctgcccgcctcggcctcccaaagtgctgggattacaggcatgagccactgcgcccggcccatgaactccctacacttctaagttgtatcaccctgacgctttggtatccaagagaatgttccatcccatctcctgtggagtagtgttccattcgaattcagtgtaggagtctgaaatgccaggcaagtgcctggtaacctggctgcacagcagaggctaaagcaaagcacaagcactcctgagacaagtaactgattgatttcaggtggtgaaaccacactagcctaaggggagatggtaggccatgaaagtggctgaggtggagcaagcgtctgtggacccagatggtgatggtacagagagattcggagtaagcagaaaaaatgtgatgtcatgtagccatcgcgtaaccactgttaattatacattttcaagttctaatatatgatgtgaaatgataaactccttaaggtaataagtattagttcactttgcatatgcaataagatagtcaactcaaatttggtcttcatcagatattaaagaatttttcttcaggtccaacagaaatgatttacgtaagtctgaaaatttactaaagcttaatttaggttgatgcactagactggtatgtttcccttttaatgtagtatactattatgaattagatctttcatcatggaaacagcagcttccaattcttgaagacagtcagtggtgaatggttatttaagtagtagctcatctgtcaatataaactggattcagggtatacaggttgcacacacacacacacacacacacacacacacacaccccaatacaccatacagtcataccttggtatccatgagggatttgttccagtacctcatttggatacctaaattcatggatgccaagtcccttatacaaaatggtgtagtatttgcatataacttacacatatcctcctttatacttcgaatcatctctaggtaacttataatacctaacacaatgcctacatgtttgtgtgaattcaacatagtacttggtgcacggcaaattcaaaattttgcttttggaaccttgtggaaatttttgatttatggttggttgaatccacagatgtggacaccatggagatacatacacacatacacacaaacatatatatatatatatatatatatatatatatatatatatatggttatggacatagatatggatatttatgtgtatatatagatatacatatgtgcatgtattatatatatatgttttgttttttttttccatctctccattggtaatatggttgaaagtagaactttctcttttccacctctggcttctcatgaggtcacctataaggcttgacacagtcacattggcttgacactttgtgtctagaaagttgaaaaagtcactgactgtttcaaataatgaaagtatattctccctcacagtctcagaggtgaaatctgaaaagtgaaacatttacagaggcacaagttgatctttcacatgaaggagtctaaagttgataatgcagtagggaatgcagtcctattgtttttattttccccttcctgagcatacatccagctcagctgtcatgggcacctctgatgctccctgagcagggattttaaatgactccacagcagactggtctctgactgaatcatgtgcaacaaatcttgggaattttagttcatagcaagtaaatagcactgctttagggtaaagacaaattttcatatttgcttgttagaatattttcatttctcttataaatcaagttgaaccaaaatggtttaggattattttctgaggaaatatgtttttgtggacttttggtctatggtcttaatgattcctgcagagtctgacatctataccaatattttgtccaccaaaaaagcagccagccttgatgactgaaaattcacagccatgcgtgcttgtccttaagcaaagactgctggggtggggagagatgaacagaaggtaatgagatgtgtgtccttatctgaaaatcactctatgttccccttcaaaaacctcttttaaaagtttttttttttaaaggttgagctctaatataatgctaacattcatcacaaaacagtataattgcctcctcctactgtaaactctagcttagtgaagccaaatgctgggaattgctttgcttagacttataagatatagaggccaatggtcagaaaaccaattgacatcagggatttagctagtaaaacaacttccagggaatggtcctgggtcagatccattaaggctgattgttcacatgttttatgcctttccatctccatctgaagtatagtcacctttacaatgaggactttaggggactacacagccttcagttgataaaaagtaactcacatttatgaaggttaaaaagggggaaacgagttttaaaactttttactgcaaatggtgaaataaagtgggttttcaggtaaatccttaattattttctggaaacaccccattcccagagaattttaattagagccttgacgttagtattaataatcataggctttatttatgatattctacttgttaaaactttccactataacaaaccaggtcaaccttctggttggcagactattaccaatattctcttgtaacagagtgttgatgtccagcctcctagaacctctgtttgaaacacattatcctgcttttaagcctcaaattatggccaacccagccattagtgaaggaaggatgatgttattacttactttctaaaggaaataatatgtgggaaatgggagaaggtaaaagacattgctgatttatttttggagcacaaactaaaggaagaatggattatcagagacttcttgcctctgctgtgacagttttgccccaccatttgatattaacattcatgaagagctatctataattctctggagcccaggagcaatatcccttcccatccaggtaatccatcactctgaagggtggacagacaataggaatgtatgtttcctttatcgctccctgccagtagaggaaatgacagtcatactgaaactctttaatatcttgcttgatgtgtaggagtgggtggattatttacccaggttcctattcttcccagggcatggtcagcattcatcctctctgagatgtagagcacaagaataggagcatccttaggttggagcaaaaatgaatctgtctaaatctgtggttaccaagtaacatatgtatacaaggtggaagggtgattggatgggggtttgcttgtatattacagtctctgatatggagaatgctgtatattttgcaaaatcatcactaccaccactgaagttgcaaaatactagtcaagtctgagcaagtattgttactaggaaaaatggttttctccactgaagtcctagcagtaacaaaagatgagacattcgggattatcccctctccacaaaaagctgctatgctatattgaagactggagagattatgctttcactcaactacatgcacagagctaagcatttgatacattgtaggagtttgaaagttatactctgaatgattaaataaagttagaaaggtaattatggggcctctgaattgtcgttcttgttacatgattaaacttgtcatggtctatttctgccatttctttttattgcctcttttcttttttcccactcatttttttttttgtattcactgactatagtgtaatcacactgttggaaactagccttaaccatgtggttgtaaaagaaaatccttggcaggtaaggaaatggagactcagtgaggtgaatccaaggtgactcatttaataagtgtcagagtcaggattctacctgagttctacattctagacttgttatttttcttcttccctacaccactgccagaggatatttatatggtttgtactaaaaaagtcatcatctgtgaattaattaatgcatctactaaacaggtattgaagagctctttgtataatgctgagcactgtggataagatgaagaagacatggttttcctgaggtttggagaaaccaccttccagcagggactaaactacaacacctggtaatatcataaagtgctatgaggacagagcctttaattctgcctgtggagtctgggaggcttcacagagggggcagcatttaaaatcaaacttgaaaaataaataggagtttgtggtgaaatggtctttgccatttaactatctggcatgaccccaggaaaaccaatttaattttctgatacttagttccctgtctgtctcaagattgttatgaagatgaaatgagatttgaaaaacactttgaaaacctgcagatgacattataagaagtagtttcaagaactatggatcctaaggataagagatgaggcctggtccattaaaaaaacaggatgcatgcactatttctagaaaaaaaaaaaaaaaacaagctttgatgctattgtttgaaaaatccatagtccttactgcagctgatatgggtagttatcacttttctataacacacagataagcctctaagcaagactcaggtaattcctaggaaaactgcctgccaatcagggatggaaatccatactagcatagagtagtaaacggcatgccttacaaatggtcttgggcatcagctactgggaagggctgtgcttgggatctaactcacaaaatatacatttttcaggataaattcagatctaccattttatcttcttttttatcactcaggataattgataggaaaaaaggtgcagaaatatgtccccgggccacatgaggcaaggatgtcacggtgaagagaatgtcttaataataaaaaaatgcaaagatggggggagctaaagcaggctgttttgcagtctccagataatggcgaataatgatttaaaactttgtcttagttctgtattagtctgtttctgttgctataaggaaatgcctgaggctgggcaatttataagtaaaagaggtttatttggctcacagttctgaaggttgtacaagaagcatggcaccagtatctgcatctgatgaggggcttaagttgcttccactcatgatggaaggcaaaggggaggtggcatgtggagatcacatagcagggagagatggagatggggagagggagagacagagagagggagagagagagagatgccaggctcttttcaacaactggttctcacaggaactaagagtgagaactcactcctctgagggaatggcaccaagccgttcatgagggatctgttcctaggatccaaatacctcccaccaggctctaccagcaacactggggatcaaatttcaacgtgagacttggcagggccaaactatccaaaccatggcactaatttttcataaattatgagcagtgtctaaacccatccttttcatgtttgatggatcaaatagtaaaggaatacactgtatcacgggtgtgtgtgtgtgtgtgttcatgtagttatagcctaacaccatctgtctttcttccagggtacttctttttgtgtatatgctctgtataatgttagcttacacatgatgagctactagtcctgaatcagttagctactgccacataacaaaccactctaaagctaagttgtttaaaacaacctccatttgttgaaccgtgaggagactcaggtagactcctcatgagtctacaggtctgttgaatggtttttctgaactatgctgggctgtctgggatttatatttctgtggtcagctgtgtatcatctaggacaaagctgaggttactttgatgtccagaggggagattaacagagatatagttctgtggagtaatcatctgggctaaggttatatcttctccattacagggaggttaaatttcttattaaaaggagttgtaaaagcaggcattatcttagtttacatagcccatgcagtgaactagatcatactttatgtggactgctttgtgaagcttcaggaagccccttttaggttcatcattactttatttatttattaattttggtctaccataaaagacagtgcctttgaaacagctccacaacttaagtgattatcaatcatcaattcttcatggtatgaccactctggaaacttggtggggaacgaggggggcactgaaaggttaagaaggcacaagacaggaaggtaaagatgaaattcaatctgatttcacagtttggccctaaggaatacccttaatagacccaacgacctcttatcagcctcagtttagtcttgttttgaaattaaagttaagagggtagttaggacgtttaatgagacagattggatggatgtgatggagactggtggagaaagatagaagaatcctagaggaaagcagaggctggctaatgccacaactagagcactaagcttgggaacatttaaaattctatttcctttctcctcttttaaaagaaaattgtatgtttaataggatatgtgttagtattatacaaaaaaggaaatagctgcttcttataactgcctaccaaacccctctagttataatttggtttcataattatattaaatcaggttgtaatcccttaaaactcagcaccctttacctgctaatagtgcaatcagtctaaatgccatttatagttagtctagagctgaaaacaatatttaaaaccaattttcagtctcaattcatgaaaaaaacccccatcactctatcttatttataataaactcattcgagtagatccagtcacaatataaacaactgatggaaaatccctaggaggttttggctcatacattctgagcagacatgctctggaaaacacagacattctcagaaaactgcagtctgctgaaaatgccaggagagttcaggagactggactcttcattaggccttggcatgtttcattgtttttgcatagggaatggtgtcaacacttcttatctgaacatctgtatgtccaactctttttttctaatcctgtttcaaatggacaagatcttaggacacaagagaagatgtgtgcttgggacaaaggtatgtggatgctacaacgtgatccagattttcacccatgacagccgactcttggtgggttgaaaaaggtggtaaggcagtttccatggaggtcaggcagcatgtgaatgacagctcgatgtgatagagtagtgaaagtacagaggctttggagctaggtagacatgcctgaattttgactctactattacaagctgtgttacctaagcaaactttgtaatcgttctgagcttcagttccttcatcagaaaaatggagaaaaatgtatctatctccaaatgttgctacgatatttagataatattacatctttcctcccttcctccttccttcctgccttttttcatcctttcttcctcgatttctttcattcaacaactatttattgaacactgtgccagatgccatcattgtgctgtccatatttccttggatccctttttcatttctgtgcacatgactcctggtgtgctgttactctcagaagccagcgtctgtgttgcattgtcaaaggtttgccctcaaactgacaaaggcccattttgcctgaataactaaaagtgcctagaaatttacatccctctgtgggcatcccttaaaaaatgattgataggtgggaagaaataaatgctccagtcacagtttccccttatggggaccactctgaggtgtgacctagactccagaacttgcctatgggattgagtcaaagttactatccttgggaattaatgtactatccttgcttgatttccttcccttcctagtcccatttccctagatccctactggtttcctgagaacacctcctaataatccattttcacatgaattcttatttcagagtttgtttctggcaagcccaccccaagtcacacacctttcacatattccatattcttctatgtgctaggaatgtatgaacgagtcagatatagtcttactctcatgttttattaactagaaacactgtagtgagaacccatgttaaataggttcccacgataaagactgcattttagacattctgcagaattctacatttcttctagagtggaaagagtataggtttcagagttacaacttccaaatttgtgtccctactcattcacatatcagctgaaaaacattgggtggctgcatttgacttactgagcctcacttcttccatttaaataagtttattagcacctgcggttccagactcatgggatttctatagggagcactaacagaatacgtaaaaagccttttgaaacagggcacataacccaaactttatcactacctggagatgttacgtcaacaacaagcaagagctttgaaaaataaaagtacattgtgtcattttttaggaaatgttacatattttataaggcactgctttacatttaacttcaatgtttttatctttgctgaattaaacaagtgtgatttggtagggtcagtaacaacatcataagcttggtatggttaaaatgaagatcaggctgatgcataaaacaggcaatgctacgggtgacagcaaaatgtaaacacacgtcttggggttctgctgagtgtaaagcgttgaaaaagaacagagtaaggaagcaagtcccttgaagaatccctgcccctagcataccctacccacctatcagtgccaaggaattaatagctgcctcatgtaactccatcttctgtggatggactgccaatcatcctgtctccttcaatgctgtagaaagattccctttgacatactccatcctgatgttagagaaccaggctcaacacttttttgggaatccctgtgcctacatgatactgcttctggaagctaaagccctgagatgcctgatttgctctttccggagttaattatgtccacacataattttgatggtaaaatccaaagtgggttaagcaaaaggagatatttcttgaatagatacaaggatatctccaagatcttaagggcaatacctacaatcaggcctcagtagggactggaaacaggacctggaaagtcaacataattcaaggcagacctctcctatctgtattcatatctctctttggagtatatggtcttttatatcttctcatctctattagtggcttcttttttattattcctcaaggctgattcttctgccatgtttatgcatggaatgtcatagctgcctctaaatggtggcctttagtcaagtttctatcagtttataagatgactgcctataggtagttttactgacctttctgtgtcccaataccgaatggcgaaagagttttttttttttttttttttttctgccaatataggttctgaattggtttccctgagttaagtgtctacttttggtccaattagctgtggtcaacaagtggtggagacacggcaacgacgtggcttcggggtctcacttctcagagggaggaggattgatgaagtggagctcaggatgggcacatactctgaaacatttactacagtgactcatgtgtatttcttgggttgctagctatgtttctaccacccacgtttatttagctctcagaagaaaaatccccacaaaccaagcagccaaagacaagttcaacagaaccatctggactccacaaaatttgacatcatattggcttatcttaaacccattcttttgaaacttacagtcttctgacagttggttcccaagcatggaggactacatttatatacaaaagggtactattaaggccttttactaatatagaatctttgattattctggtatatttttcaaacggatttctaaaaacttttatttcattatattcttggtatattcctgtgaattttggtgggacatccatttcagtgaagaataaacaagcctgcattgctgtcaactattatatcagcacagaaattggcctcattaaagctgagatgggctttaatttctacaatccgatgcatgttttatggctaaagtaaaataagatataaaggagaaaagaaggagaaagagaatccgcttttgtggctccaacagatctttccagttggttttctcttaaagccctctgggttggggggcgggaggaaacactatttctttccagcaagctgcacttgcaagaagctatgggaagttattgttctctaccagaatgctgctgctgcaaaagatgaatccaatcttacaagacagccaagttcttttgtcttcacagaaaggagcctataggcctagaacccggcagatgtggtcattttaaagagcttggaaactttcaggtgggttaagatgtgactgggctgtgggcaggaccatggaatcagccatgcacatcattcagttttgggagtggagagactttctcacttaaatcaaggctttaaaatacaacatcttctacctcaggcaaagcttggacaaagtagagatgcttttttgtggctttgaaaggaacaataaaccctgacaattttctcctaggtatgatgactcttgctcttactctcatgagggcagacccgtggagaccagaggtgaatacaagattttgtgaatcaggggtcagaactgggcttgtcctgccaaagcttgcatggaagttgtcatgcttgttagcaagctgtttgagtagaagcctggatcctttccatctgccactccaggtccaccttctgcttttttcccatcctgctctgtcctagcaggttgattcttattgtctgctcctatgggttccctggctttttagcccctagttgattttggccaatgaagccccaggaagagctaggtaggtaggaggagaggagaatgagatcagggtttttattccctcatctccttccctgcccagtcattgccggttggctgcttctactgaaggctacaactcctgttagattgcctgtgcccttgccttctcaggcataagagtcgtaacagcttctttatacgctattcccagagtactggattatccattgttgggttccttttaatagtcctttgttaagctcacaccatttgaatgtgcccgtctctttactgccaggctcctgctatgcaagtaggaataatgctcacctctcaggggaggaggattgatggcttcctctcgccatatctgcttccagcactctaacctgcttcatgttcagacaaaaaagtcaaccaatgtggtatttttttcaggaatactggaaggatgttctgcaaaaaataccttctatgccccacttcccttgtaatgtctttattaggagattaaatctttcattctatttagagataaggttttaattgcaaagatccttaggagaggcatcatatcccattcaatagtttaagaataattgagaggattaacattaggttctagatattgagaacaaaaaggttgtccctgatctcaaggagtttatactgtaggccaataattgatactaaattctttcttgaggattcaggggatcatagcagatgggaggcaggactagattgcagctccagatagagcagcacgcggaggcttacattgtgaagcggaggcttgcattgtgaattttagctccagatccactgcaggaagaaaccagcaatcccaagagaacccacagaccctctgaaggaaacggactgctcctgcagggcccgagagacaccccaaatactgtgagtgccccaattgtgaaggtgggaaagggagactgcctctcccgaatcactagagaagctgaaggtctgtttgcaggagaagtttccaactttacctggagctgagtcaagttagagagaggagtgaaatacaagggcagaggaagcagcagaaaggccctgggagctcgctgggtccccaagcagcccattcctgcctggcaccacagggatccattgggagggtggccagaggaacagggggtaaaactccacagggagaaggaattctctagctgaacttcgtaacaatttgagcgaggagagaagcctcctagccagaacttgggggagggcacaaattgggtatgcagacttcacaggcagaggaagaactaaagcccttttctctcacagctgggaggcacatagcctggggcaagttttcaagtcaatcttgccctccacctggaaaaagacttggggctgttggtggggggcacagtgggagcgagactggtccttcagtttgcatgggagctgcgtgaggcctgtgactgctggctttcccccacttcgctgacaacctgcatgactcagcagaggcagccatagtcctcctaggtacacaactccagtgacttgggaatctcacccctatcccccacagcagccgcagcaagacccacccaaggagagtctgagctcagacacacctagccccacccccacctgatgctccttccctatctaccctggtagtagaaagcaaagggcacataatcttgggagttctagggccccacccactgccggtccgtctccacactactacagctgatgctttctggaaagcgtcacctcctggcaggaggccaaccagcacaaaaatagagcgttaaaccactaaagctaaggaaccttgcagagtccattgcaccctctgccacctccactggagcaggtgctggtatccgtggctgagagatccatagacggttcacatcacaggactctgtgtggacaacccccagtaccagcccagagccaggtagacttgctgggtggctagacccagaagagagacaacaatcactgcagttcggttcacaggaagccacatctataggaaaagagggagagtactacatcaagggaacaccctgtgggacaaaagaatctgaacaacaaccttcagccctagaccttccctctgacagagcctacccaaatgagaaggagccagaaaacatggttcctgaattccagaaagaattcaggaggttagttattaagctaatcagggagggaacagagaaaggtgaagcccaaagcaaggaaatccaaaaaatgatacaaaagtgaagggagaaatattcatggaaatagacagcttaaagaaaaaaacaataaaaaactcaggaaacttttgacacacttttagaaatgcgaaatgctctggaaagtctcagcaatagaactgaacaagagaacaaataaattcagagctcgaagacaagatcttctaattaacccaatccaacaaagaaaaaagagtaagaaaatatgaacaaaacctccaagaagcctgggattatgttaaatgaccaaacctaagaataattgatgtacctgagaaagaagagaattctgaaagcctgaaaaacctatttgggggaataatcaaggaaaacttccctggccttgcaagagacctagacacccaaatacaagaagcacaaagaagatctgggaacttcatcacaaaaagatcttcgcctaggcacactgtcttcaggttatccaaatttaagacgaaggaaagaatcttaagagctgtgagacagaagaaccatgtaacctataaaggaaatcctatcagattaacagcagatttcacagcagaaaccctacaagctagaagggattggggacctattttcagcttcctcaaacaaaacaagtatcagccaaaaattttgtatccagtgaaactaagaaacatatatgaaggaaagatacagtcgttttcagacaaacaaatgctgagagaattcaccattaccaaaccaccactacaagcactgctaaaaggagtcctaagtcttgaaacaaatcctggaaacacatcaagacagaacctctttaaagcataaatcacacaggacctatacaacaaaaatataaaagcaaaaacaaaaaacaaacaaaaaaccaaagtacacaggcaacaaagaacacaacgaaagcaatggtacttcacatttcaatagcatcattgaatgtaaatggcctaaatgctccatttaaaagatacagaactgcagaatagataagaactcaccaaccatctgctgcctcaggagactcgcccaacacataaggactcacataaacttaaagtaaaggggtagaaaaagggatttcatgcaaatggacgccaaaaggaagcaggggtagctattcttatatcagacaaaacaaactttaaagtgggcaaattcaggttctccggcaccgtagtggtagtcgctggcccaagttagaggccaactgagaagtcttcgtgccttagatttgttgacctacagaatgcttcaatatccatatttttgtagaatgtataaagaatgtctttcatgttgtttggaatctggcatacctaatttaggtgtctggccaaaaagaatacatactacagcagaaaaatataaagaatatgaagcccaggagcaaacagatcaaactcaagcccaggagttaaacagatctcaagatagagattttgaaactattggtaaattacatattccagcaatggtggatgaagttgttcattgtttgtcaccacaaaaaggacaggtttttctagatatgatatttggttcaggagggcacacaaaagctattctacagaaggagtcagatgttgttctgtatgccttggacagagacgcaacagcttctgcattagctgaacatctttcagagctgtatcctaaacaaatccgagctatgctgggctagttcagccaggctgaagccttattaatgaaggctggagtgcagccagggactactgacggagttcttatggatcttgggtgttcctccatacaacttgatactcccgaaagagggttttctcttcagaaagatggccccttagacatgaggatcatgatgatggatggtggcaggtaccctgacatgcccactgctgctaatgttgtgaatgctttagatcaacaggtacttgcatctatcctaagaacatatggggaagagaagcatgccaagaaaatcgcttcagcacacagcatctaccccatcaccagaaccaagcagcttgccagcatcatcacaggagcatttcctccctctgctatttatgcacgaaaagacttgctacaatgatctactcatattgccaccaagactttccaggctctttgcatatttgtgaacaatgagctcaatgaactctacacaggactgaagacagctcagaagtttctgagacctggtggttgccttgttgccctctccttccattcactacaggattgcatcgtcaaaagatgtttgcttagaataagcacgacagaaaggtttaacctaagtgttagacagcaagtgatgaaaacactgcaactgggttcagatcacgaaaacacggaagaagtctctatgagaagagctcctttaatgtgagaattgatacacaagaaggtacttagtccacaagatcaggatgtacaagataaccctagagggtgctcagccaagcttagaggagctatcaaattataagtcaccatcatcttattcttcaaatttttttctcacaatttctctaaccttcactcgtgttatgttcctgaacaccttgatataggtttaagtgtgggacagtctgaaaagtgatagcatttagcatttttttcccctcaaaaagaaactgtaggaaatattaccatgaaagttccactcagggagcagcagcatctcaagactggaaaaatgtgttaatctttacattggactcttgaaatgcagtccttcctctggccaggaaattttatttaaataatactatgttgtgtttatctaaatatgtaaacccaagctgtcaaatcatacctgcatgtcctaaattttgaacttagatatttgcaacagtctttctctggctcaaatgatgatgattatggatgaattttaacgtccctacttgtgaataattactatagctttgtcaaatgtaggctttttacaaattttaaattttaaaatattagtttacgtgttatactgataaaatttcatttttcaaattatagtctattatttcaaagagatttttcagtacgatatgggccattttgttcatatatagcaaagtaaaaatgtaaaatccttacagcgaattgtttgacaaaacttatatttcatgtcaatttatttaataatagctcacaatgcctttagtacataataaagtcttttattagaatcttatatgttttaattgagctaatcaaaataattcagccaagtctattcgaaatagaaaactatttaatatagtaaaatcaatgctcccttaacggtgttacaaagatatggtaactgtaataagggtaaaagtttattcaagaaaagagtacttggtagaagattctttaacaaattgatgagattgattcataattcacatgtcaactttttatatgtaatatgtacttctaatttattcagttattcatcaataactgaaagcaaagtaaaaaggtaaaatcaagcaagtactgaacttgtcattagaaaagcaaaggtaagtacaatatacatggcccacagtacatgtcctatagagtttagtagaggaaaattatgttaattataatcacaaaaatcaatataaaatggacatagtggcaaatactacaaacaagtcgtacttggtactgtaagagcatctagtaaggattttatctgttgtcagaaaccaggtatgagaacataatacttgaattgtgacctgaaggatgagttggagataattagtcaaagggcacttggggtatggaaggggacatgttgattaacggtacacataaataaatattctcttaaatagatatccttgaaatcatatttataccattgatttgctcagtaaacatttttcaaatacagaaaaaaggttctccattatggttacaaattttaagttggtggatccaagtgaatgaaatatcagcataactgtatgggcaaaatagataagaattaaatacatgaatttacctcagacttattttatctacctctgtaatatttaactttagtacccaggcttgtttactacttctgctttacaggctttatttaaatctgaacaatcctacagggaaatcagaattagaaaaaaaaaaatctggagaacaatatgcttcaaatagaaacaagagaatgcaactaggttaattctctgaatcctacttgaagaatgtataaagttctctttgcctgcaacacatatttgtgaatgagacatattccccaaaaattcttatccctgtacgtaattggaaaataaaagatcacatttgtatattcaacaaccattcacctatttcgtaagtcattttttcatcctttatagtatgggaattattttttatgttaaatagaaactgaatgctctgggttgaacagtgtcccctcaaaattcatgtacttcctagagtccgagaatgtgaccttatttggaaataccgtcattggggttgtaagtagctaagatgaggtcatactggagtagggcaggcccttaatccaacatgactggtgttccttgtaagagaagatagggctggtgtggtggctcacacctgtaatcccagcactttgggaggccaagccgggtgaatagcttcaggtacaggagttcaagaccagcctggccaatatggcgaaaactcatctctaccaaaaatacaaaaaattagccaggcatggtggtgtgtgcctgtaatctcagctacccaggaggctgaggcacaagaatcactagaacccgggaggtggaagttgcagtgacctgagatggcgccactgcactccagtctgagcaacagagcgagactctgtctgaaaaaaaaaaaaaaaaaaaaaaaggaaaataaaaagaagagaagatagagacacaggagagaatgccacatgaagctggagcacagattggggtgatacatcatggcaaccatcagaagacaggaaaaatgcatggaacagattctccctcagagttccagaagttgccaaccctgctaacgtgattttgcacttctagcctccagaatggtgagagaatatatttctgctgttttaaggtatccagtttgtggtaatttgttatagcaatcctaggcaactaatactctgacagaaaaaaatctcggataatatgcatgagaaaaatctttcaataaacacaaaattggtatcaaaatgttttcatgtaaaaatagattaacttttctgtaattaggctgtgttttatagtcattcttgcctacttcttagtctttgttgtaggatgcataataaaatacatgaatgagttttaaatggttaactttggagaaaggttttgggaagctcatacagtacacagaaataaaagctgatgttacaatgaatgtacattacttttctaataaaatatttctgaaatattcaaaaaaaaaaaaacaacacaccaaactttaaagcaatagtggttaaaagagacaaagagggacagtatataatggtaaaaggccttgtccaacaggaaaatatcataatcctaaacatatatgcacctaacatcagagctcccaaagttataaaacaattactaatagacctaagaaatgagatagatagcaacacaataatagtggtgggctttaatactccactgacagcactagacaggtcatcaagacagacagtcaacaaagaaacaatggatttaaactataccttggaacaaatggacttaacaggtatatacagaatatttcatccaacaaccacagaatacacattctattcaacagtgcatggaacgttctccaagacacagcatatgatgggccataaaatgagcctcagtaaatttaagaaaactgaaattataacaagcactctctcagaccacagtgaaaaaaaaccggaaatcaacttcaaaacgaaccttcaaaaccatgcaaatacatggaaattaaataatctgctcctgaatgagcattgggtcaaaaacgaaatcaagatggaaatttaaaaattattcgaactgaatgacaaaaatgacacaacctatcaaaacctctgcgatacagaaaaggtggtgctaaaaggaaagttcatagccctaaatgcctacatcaaaaagtctgaaagagcacaaacagacaatctaaggctagagaactagagaacttaaagaactagagaaacaagaaaagaccaaacccaaacccagcagaagaaaggaaataaccaagattagagcagaactgaatgaaattgaaacaaaaaaaaaatacaaacaataaatgaaacaaaaagctggttatttgaaaaggtaaataaaattgatagaccattagcaagattaactgagaaaagaagagagaaaatccaaataacctcactaagaaatgaaacaggagatattacaactgacaccactgaaatacaaaagatcattcaaggctactatgaacacctttactcacataaactagaaaatctagaagaggtggataaattcctggaaaaatacaaccctcctagcttaaatcaggaagaattagataccctgaacagaccaataacaaacagcaagattgaaatggcaattaaaacacatgcacacataagtttattgcagcactattcataatagcaaagacttggaaccaacccaaatgtccaacaatgacagactggattaagaaaatgtggcacatatacaccatggaatactatgcagccataaaaaacgatgagttcatgtcctttgtagggacatggatgaagctggaaaccatcattctcagcaaactatcgcaaggacaaaaaaccaaacaccacatgttctcactcataggtgggaacggaacaatgagaacacatggacacaggaaggggaacatcacacaccagggactgttgtggggtcgggggaggggggagggatagcattaggacatatacctaatgctaaatgacgagttaatgggtgcagcacaccaacatggcacatgtgtacatatgtaacaaacctgcacattgtgcacatgtaccctaaaacttaaagtataataataaaatttaaaaaaagaatatgtaaaattttaaatttaaagatcaaataatgaacaattattgtattcatgtaattttgtccttaaatatatcagttggctaattaaaaaaaaaaaactaccaacaaaaaaaaaagcccaggaccagacggattcacagcagaattctaccagacattcaaagaagaattggtaccaatcctcttgacactattccacaagacagagaaagaaggaaccctccctaattcattctatgaagctagcatcaccctaataccaaaaccaggaaaggacataaccaaaaagaaaactacagaccgatatccttgatcaacatagatggtaaaatccttaacaaaatagtagctaaccaaatccaacaacatatcaaaaagataaatatcagggatgcagggatggtttaacacacgcaaatcaataatgtgatacaccacataaacagaattaaaaacaaaaatcacatgatcatttcaatagatgcagaaaaagcgttagacaaaatccagcatcactttatgattaaaactctcagcaaaacccacatacaagggacataccttaatgtaataaaagccatctatgacaagcccacagccaacataatactgaatggggaaaagttgaaagcattccctctgagaaatggaaaaacacaaggatgcccactctcaccactcctctttaacatagtactggaagtcctagccagagcaatcagacaagataaagaaataaagggcatccaaatcagtaaagaggaagtcaaactggcactgtttgctgacaatatgatcatttatcttgaaaaccctaaagactcctctagaaagctcttagaactaataaaagaattcagcaaagtctccggatacaagattaatgtacacaatcagtagctcttctgtacactaacagtgaccaagtggagaatccaatcaagaaatcaatccatttcacaatagctgcaaaaaaaaaaaaaatactcagtaatatacctaacaaaggagttgaaagacctctacaaggaaaactacaaaacactgctgaaagaaatcatagatgacacaaacaaatggaaacacatcccacgctcgtggatgggtaggatcaatattgtgaaaatgaccatactgccaaaagcaatctacaaattcaatggaatccccatcagaataccaccatcattcttcacagaattagaaaaaaaaattctaaaatgcatatggaatcataaaagagcccacatagccaaagcaagactaaacaaaaagaacaaatctagaggcatcacactactgatttcaaactatactataaggccatagtcaccaaaacagcatgtgactggcataaaaaaaaaaaaggcacatagaccaatggaacagaatagagaatgcagaaataaacccaaatacttacagccagttgacctttgacaaagcaaacaaaaatataaagtggggaaaggatacccttttcaacaaatggtgctgagataattggctagccccatgtaggagaatgaaactggatcctcatctctcactttatacaaatttaactcaaggtgaattaaggacttaaacctaagacctgaaactataaaaattctagaagataacattggaaaaacccttctagacattggcttaggcaaggatttcatgaccaagaacccaaagcaaatgcaataaaaacaaagataaatatctgggacctaattaaactaaagagcttttgcatggcaaaaggaacagtcagcagagtaaacatacaacccacagagtgggagaaaatcttcacaatctatacacctgacagaggactaatatccagaatctacaatgaacacaaacaaatcagtaagaaaaaatcaaatagtcccatcacaaagtgggctacggacatgaatacagaattctgaaaagaagatatataaatggtcaacaaacatatgaaaaaatgctcaacatcactaatgatcagggaaatgcaaatcaaaactacaatatgatgccaccttactccttcaagaatggccataaaaaaaaaaatcccataacagtagacgttggcatggatgcaacaatcacggaacacttctacgttgctggggggaatgtaaactagtacaaccactatggaaaacagtgtggagattccttaaagaactaaaagtagaactaccatttgattcagcaatgcctctactgggtatctacctagcagaaaagaagtcattatttgaaaaagatacttgcacacgcatgtttatagcagcacaattcacaattgcaaaatcatggaaccagcccaaatgcccatcaatcaatgagtggattaaaaaactgtggtgtatatacatggtggaatactatgcagccataaaaaggaatgcattaacagcatttgcagtgacctggatgagactggagactattattctaagtgaaggaactcaggaatggaaaatcaaacatcctatgttctcactgatatgtgggagctaagctatgaggacgctgcaaaggcataagaatgatacaatggacttcggggacgtagggggaagagtgggaggggtaaaagacaacaaatatggtgtagcgtatacagctcaggtgatgggtgccccaaactctcacaaatcaccactaaagaacttattcatgtaaccagatacctcctgaatcccaataacttctggaaaaataaaattaaaaaaataaaaataataaattcttgattatatgttttgctagagaaacaggaaggctttggtcttttgatgacagagagaagcttagggaatttggaaaaatattaagggggaagaagcttgtagctcccaagatagataagctaattatttctctctctttctttctccctcctttcttctaacatctccctcctttcttctaacatcttcgattttttttttttcaaaacttgaagaaactttgataacaatttgccctaggtccctccttaactgattgggaaactgaggacaacagcgtttaagttgcttgcccaaatcatacaactagatccttggctgctaacttttcaaaaggccttcataaaatttcacagcagagactactaacgccggggttggagatgcctgtgaagggagcatcaagaacatctggtgatgaagagagaactggactggaaggaagggcatacgtgggcacttctctggatgagtctgtgtgaagagagtttttttttaatgtgagttttattcatgataaatgataaaaagtaggaaaacaaagcactcatgtttagtgtcttgaacattgtgtattgttctttttggattggaaaaaatttaattcaggactatatgaacttagttggtacagtttctccagggtagttttactgacacgtaagtcacagactgatatttcagatccttgccaggtatcctagctatgtagacatatacaaattgaattttggtatatggctacatttagccacactgatatgggcttcatcagttaaatatctttatagcaggctctcacctttatcccttcacttgtctacctaacctcgatattcttgttattggggaagggtttggggagatgagaagctggcatccttgaagtgagactcccagtgaaagccaaatgcatgcaaaagggacattcccagagtgatggaaccacacagtgggtggacagaaggttgggaaacaggccagataagacaatgttttggtttaaggctacactgataagggaaggatgaagcatggtttccaggtggcgtgtttctctcttttaatgttgtttacagaggatgtctgtccaagagaggtgagttttggaagaagcagcctcgtgttatatactttggttggtattttgcagatcacaataatctaattgatagatttataccacatgtatttgtgcatacacacacatgtatatgtcactgttgtagagttttgccagataattacaggaattatttcggttctagaactttataggggcatgataactgcagtctgagcactcaagagtggagcactcttccactctttgggaagctgctgatgacaaagcaaaaacacctcactctgtaccccaggactccaggggctgcattaggatagggtaaccatgtcagatgacctgaagaaggatcaaaaaattggccaattatttgactaggacatttttggagggcactctaccttgcagcttatcaaggatgtataattctatgtaatgaatcatgtacctactagcaggcagaacttctaggaattcccatgatttatataaaagactattgacacttccaagctgtgatctacccaagcacttggcccactccctcaaggactttgggctgtgagagagacccacacatcctcaggtcctggtctcccagcctcgagagattctacccaaacaccaacctacaaccattttgtacattcattgccagatgtctgatgtccttaaaagtacataattttcagcttttgtggctgaatccttaaatgggctcttaatctccacagtccttgaattgtgacaagctttcaaaggaagagatctccacatcaagggtttgagcacagtttgaaaggagtgcttagttgcagccattagtccaccagcaggaaactagcaggctgtcatcacatgcagccccacattagcagcaaatgtaggttctcaaggggaacactaggaagacattattctacacagggcctgggattactgcctgtgttgtaatgcaaaatagaacctgtgaaatgaacaatgcatgggtcttaaatctctttcttaaaaaagaatctctatcgcaagaacaaaaaaccaaacaccacatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacattgtgcacatgtaccctaaaacttaaagtataataaataaataaataaataaataaataaataaataagaatctcaaaaaatagatgggaatggaggcctttgcttttctcagttgtatcaccattgttgccaaggttttcttctctgccattaccatctcatggttgttctaagttcccacctttggtcgagtgattccctgatacttggtgaaaaccaaaacacaattatgaaagcagtgcccttctactgattggctggaggcatcctttccattgagttggacttcttattttactttgttcccatttgtcacctcatctctgttgattctgccttctaaattaattcttctgccatatgacttaagtctcctactgctaactcctctctttacttaacctcatctatttgaattccctagtgtcagttattgcttggggaacaaaggaaatggaatggcttcttatatttatttcattttttttctcccgtgggagacttctgagagggagctttggcctattcagaagtatacagtattcacagacgtgtacgaggtctgccccctgacatttaatctttaaaattattcctcgtagccaactctagtcaactctggaaatttctttatatttaaaatgaggctaactcattcttgggatctggtgtttccagatgttcaagtgttgctattcttcgattgactcagtctctgccattgaagtttcagcaggagctgacattgctttcccatgccttctcataactcattacagtcttgggaaagtcactcctggaacatccccaaagtctggagcgctggaatctgaaaaggtacacagcagcagccatccacctgcactccaaccttccatgttatcagatctgtcgtcgtgttgaaaagtcgtattgtgatatggagctcaactgttgtcctcatcttgtacaaagagggagagaggcctgaggagccttgggttatagtttccagtgaccagctctgtgagcttgaacaaacagcttttctctgtctctcagtctgtaaaatgaagtggtttgatgtttgatcaaattctatacagtttggaattattctttctcttaaatttctgcatggaatttattttcctcgcttataaaatagattgcatttccaaactgtagtcctcactgtattatttcccagtctttttcctattatcctaattgtcttactttttgggtacgatagcttcccatttaacttgttaaaacctttttatttttatctatgatttattaatgtatcactttttgtatagaacattcaaaatatttttagtaaactaaaatttcctttagttatattatgttagtgaatttttgttgaaatgtaacatatacgcagaaaagtaataataagcatagggttgaattgccaccaagtaaatcccacttaattataacccagatcaagaaacaatttaacaagcttcccagaatccccctccatgccccattccatttactcacctccccctcaagagtgaccactctgcagacttctaacactatatatttgcatcacctgtatctaaactttaaataagtggaatcatattgtatatattgtttgcggtttggcttctttcaaattatgttttgagattcacatatgttattgtggaggaactataatttcttattctcattgctgtagagcagtttaacttttcaaatgatttttttaaactagcataggaatttccgttctgtcttcttagaccaaataaatgctgatgatgtctctgtggagaaagagtttatatgctagaaagtatcacaacagaatgatataagatgttttaacctctttccacctgtgaccatggtaactactggaaatgctggagagtgtggcgctcaaaagaagctaccagactgttttgtggatatttcagaggatcccagaatgtcctcataaattaaggaaaagtagaccttaatccatttcactgatcaaagtacctgatccaaaaatcaggccttaatccatttcactgatcaaagtacctacaacatataagctccattacgtattttgttatcaatgttactttggaaatagacagatatgaaagcacataatcaacaaactatgatcaatagatcaaataactcctggggctccagggtggggacaggaacacaaggaagaagaagtaacaatgtagtagttggctcctccagatgaaaaaagtctaataagcaaagagcaaggctgggcttagtgtatgcactcaggacattctgagttcaagtttgaacttgtgtaccattggccatgcctttgaaaagccagttgattgatgcttctaagcaaagagttttcaatacaatcaaacattgctacttatcaagattatatattctagtgatagatttgatgccctaccaagatgggaattattcatgtgaaaagtctgaaagctcatagtaggagtataatctcaagctaattatccaaaatgcccaatttctcctatacttctttacaaagatttgccctagattctttcatgcttttttacctttctcctgagggacaattagttgttaatttcttcctttagtatcttttagcaatctccaaagtgaaccaaaaagtcagattcactccctttagataaaagatcttggacattttctcttctttcttggctgtgggcaaagattttttttcttttactcatttccttgtatccatcaggagttaggatgaaggcagcatatttatttgatgtagagtaagtggataactcagaatccttttaaaatgctatccatttaaaaggtcagtagtcccatgtcctttgaggtttatctgtctggcacttgggggagggggacagtaaataaatctgttgaggctgatgtgagttggggccatctgtgccgtagacaagtgaatgctgcagacttagaaaaggtttcaacaaactgattttaaatgatttttttttttttttttttttttttactggaaacatgacgtggatttgatactctacaatagggcactccctgagagttgtgaagtaggatatgggggaatgattgatttatttggtaaataaaaagtgggacaaaggagaggagactaggattcttaaagttcagtttaacaaagtcagaaacaaaaaaaaggaaatataaatgataccacagaaatacaaaagatcatcagagaatattaggaatgactatacactaacaaactggaaaacctaggggaaaaggataaattcctggacacatacaacctataaagactgaatcaggaagaactagaaaacctgaacagatcaataatcaataataatcagtaacaagattgaatgagtaataaaaagtctcctaacaaaataatgcccaggaccagatggcttcactgctgaattctaccaagcttatagagaagaaccaacaccaattcttctccaactattccaaaaaattgaatagaattctccccaactcattgctcatggccagcattaacccgataccaaaaccaaacaagaacatgacataaaaagaaaaccacaggccaatattcctgatgaaaacagaggcaaaaatactcaacgaactaccgcaaattgaaatcaatagcacatcaaaaagataatacaagctggccatggtggctcatgcctgtaatccaagctggggtgagaggatcgcttgaggccaagacttcaagaccagcctaggcaacatagtgagactctgtctttacaaaacaaaattttaaaaaattttggtacacacctatagtcctagctactcaggaggttgaggtgggaggattgcttaagcccaggatttcaaggttacagtgaactatgatcatgccactgcactctaacctgggcaaaagagcaagatcctgtctctaaaaaaattaaaataataaaattaactaaaagataatgtaacaggatcaagtgagattgcatcccatacaagggtagttcagtatacataaaccaagaaacacaatacatcacatcaggagaatgaagccaaaaaccatatcatctcatagatgcagaaaaagcatttgataaaatcaacactgcctcatgataaaaaaaaaaaactctcaacaaactatgcaaagaaggaaaatatctcaacataataaaggtcatatatgacagtctcacagctaacatcacactgaatgagggaaagctaaaagcctttcctctaagaactggaataagacaaggatgcccactctcaccattcatattcaacatagtactgggagttgtagccagggcaatcaggcaagagaaagaaagaaaaagaaaactacatccaaattggaaaagaggaagtccaattgttcctctttgcaaatgacatgatcttacatttagaagaacatgatgactccaccaaaacactcttagatcttataagcaaattcagtaaagctgcagaatacaaaatcaatatgaaaaaattagtagcatttctatacaccagtaatgaaatagctgaaaaaaacaagaagacaatctcatctgcaacggccaaaaaaaaaaaaaaacgcctaggaataaatttaaccaaggggggtgaaagacctctacaaggaaaatgacaaagcactgatgaaagatattgaagaggacacaaatggaaagacatcccatgctcacatattagaataattaatattgttaaaatgactatactacccaaagcaatctacagagtcaatgcaatcaccatcaaaataccaacatcatttttcacagaaaataaaaaacaatactaaaatttatgtggaacccaaaaagtgcctgaataccaaagcactcttgagcaaaaggaacgatgctggaggcatcacactacttggcttcaaaatgtattacaaggctaccgtaaccaacacagcatggtactagtataaaataggcacacatggaccaatagaacagaatagagaaccccgaaataaatccacgtatttgcagccaactgatttttgacaaaggcaccgagaacatacatggggaatggataccctcgttaataaatggtgctgggaaaactggatgtctatatgcagaagaatgaaactagacccctatctctcaccatacacacacaagaagacccctcaaaattgattaaaaagcttaatataagacatgaaactataaaactactggaagaaaatgtaagggaaacactacaggacattggtctaggcaaagattttatggctaaatctcaaaagcacaggcaacgaaaacaaaaatggacaaatgggatattaaactaaaaagctcctgcacagcaagggaaacagagtgaaaagacaacctgtggaatgggagaaaatattttcaaactattcatctgacaaaggagtaatatccagaatatacaagaagctcaaacaactcaatagcaaaaaagtaataaacccattaaaacatgggcaaaggatatagacatttcttaaaagatgacatgcaaatggccaacaggcatgtgaaaaatgctcaatatcactaatcatcaggaaaatgcaaatcaaaaccataatgagatatcatttcatgccagttagagtggctattattaaaaagacaaaaaataatagatgctggcaaggattcagagaaaaaggaactcttatgatacactattggtgggaatgtaaattagtacagccattatggaaaacaatatgaagatttcataaaaaactaaaaatagaactacccatatgatccggcaatcctactactaggtatgcatccaaaggaaaggaaatcagtatgttaaagggatacctgcaaccccatgtttactgcagcactatttacaatagcaaagccgtggaatcaacctgagtgacaatcaacagattaatggggataaagaaaatgtggtatatatacacaatggaatactacttggccataaaaaacaaaatcttgtcttttgcagcaacatggatagaactggaggtcattatgtttagtgaaatcagccagccagaacatatgttctcatatgttctcactcatgtgtgggaagtatagaagttgatctcatcgaggtggagagtggaatgatagatatctgaggctggcaagggtgtgtatgcatagagaatgaagaaaagttggctaatgtgtacaaacattcagttagatagaaggaataagttctaatgtttgatagcagagttgggtgactacagttaacatcaatgtattgtatgtttcaaaacagctagaagagaggacttgaaatgttccaacacatataaatagtaaatactcaaggtgatagataccccaaataccctgactttatcattgcgcattctatgcatgtaacaaaaaaccttatacaccctataaaatgtaccaatattatatatcaataaaaattcagcttaaggtctagattgcaataaaatcctgtgtttttgattattagaaatcatcatctacttccccttccaatttcccctatttcctttaacattagtttattctttcattttatttacaacttttgagattttaaaaaggcaccaggcagtatttactactattattactactcttaatactactaactaacaaatgtgtaatgaatgcttactatatgtcaggcatagtgtcagttgcttcacatatgttatttatataatcctgtcaataatccgatgagatagatattatgtccaatttacagatgaagaaactgaggttcagagttgttaagcaacttgcccaatacaatcccactagtaaatgctagagatagcattcaaacccgagcaatcttacaacagaacaaatggcaaaaactgcagttactttgcaccaacttaccgttattaccaacctttccctatttcctaagtgcaacttctgaggattattttcaagtgaatacacatttaattctttttcttaattttcagcctcaaatacacttctatggattccatttattcattgctttatgtgtcactgtaaaaccacatcctagttaaatcccacatctacctaaatgtagattccaagaatctaaggaataccattatgtgtaaagcccccgaggatattaaaaagaagaaataattctgtcctctgttgatcaaggagttatgatatgtacaccaaataacttcaaagtcaatgtgttaagttcaaaaagatgttacagataaaaattatgggaatttagatggaagcagcatttgggtcgaaaattaagagtaagcaggaatttgacataaaaagaaacagagttcactccattacacatggaggcatagttaccaggaagaaaaggacatatttgcagtgctggctgcaataaatttatctgattgggatatgggctgtgtcagtggcatacttgagctatacctgcactgaaactcaccgctctttctccaccccaacgttcctttcaattaacatctctactaaaatgaaactcatatataataataacaaactggggtcttttttgtcatagtaggattctggcttttttatatctatatgataaaaggacttacatatggttagcatatctatttttctgaagcaagtatatgaatatactttagaagaatttttagcaggatttaaaaaaaatggtttagtttaacttttggctaatcatattcaatgtactgtattggaaagatgatggacttttcagttagaagatctgagtttttatcagtttctggtcgtacaatcttaggcaaacactgagcctctaggccccagctttgtcatttgtgaaactgggataatagtaatgcttggcttgccttcataggtagttgtgaggaccaaataaataatacatggactcaaaaaacatctacaaattctagctgctaattaaccagtaaagtaaattatttggtagatctcactccagagtcattctgtttaattggtatttgattccactcatcttgttcctgctgttaaggtcttccagtgtcatcatatctctgaacaaatttaaccattagcttcgcagtcatacataattttttatgcatacaaagttcctatctctatgggatgtattctctgcttctatattttttatggttgtagtcagagttagttgtttcatgcagtatctaaatttatatgagtgtgtgaggaaaagagttatgaaagcaaatgagagggggaaaaactcctcacagataaggaaacagaaacagcagatgaatgctgccgagaatttctctctggaaggtgataaatgtattcaatatacttgtatatatcaggcactagattagtcacaaataaggtgataggtactccaggtttagcttgagaggccactagaccgttttgtgagatttctaaaatctcatctatttggatcttggagtttgagaagatgcaatcaccttaaaagctatattagaactgatttggttaagctacttactgagattgcttaaggtctgtgagttgttttttaaaaactatgttggtaaggccaacgatgagaattcaaatttactgaggctttattctaaacatcactccagactcaatcctgggaaactgctttgcaagtagggagtggaaaagagactaataaagcatgaagggcaaaaaacagaagagtgcagccaatttagggtttgcattataacctaattaggatggctcaagagagtcttatattttctgcatatgaaggggcagtgaaaatagaacacagatgtgatcttcaaaaaatccagtgtagtagcttgagcctaggagaggaaagtgacaagagaaacctcttcagttgtttcaagtaagttgtggtccatagagaaggctgcaaggtttatagaaggagactcagaaagaatcacagcattttagatctagaacattgtcatttttcaagtgagtgaactaagaggggttaaagggcttaccaggaacaatgtccttgataatactgcagctagtaccattcgtgggatttctccaatttcaggtgatgactttcctatacaatgttagaattgttttcttttgtgattttctctcaagctttatgtcagcacagttctgattatctccgtcgtggtgtcttcaggctaccttttaaaatccaaggcaactaaagttcctttacttcgcaagtatttactgaaggactgacttctttatgccaggtcctgtgctagccgcaggtgatacaatggtgaataagacattgtaatgcaagcatacttcggttatgaacaatcatcacagatggacaatctttcactcaaagtttattcaatgtatgtaaattcaatgaaaatcaaattttgggattacaaagtgatccaatcatctgcaatgtaccacttctctgattcaaatcatccaaagaaaaaaagcatattagatagcttagggatggtgaaggttcattgtttccctttcacatttcttactgaggttgcctaacgggccaaaagcaatgttcagtttgcaattttataaatttatgtccttgaagtttggatgcaaaatgaattcatttctggtaggacttcccaggagatttggttggttcaagattatgttccaaatagatgtgtttaagaatctcaaaaaataatgaaactgtcctattcatggccatgccacctgactcccccgattcatccctgcctgagccaaaagtaaagcaaaacaatacaaacacatttccaaccctaagtagcatcctggtgcccactgttgaatctgaataccctatctaaagcaaaaccacaatttgcgcattcagtcaatgaaagccacacccccaaatgtttttgtaagattgttgaaaatgtaaaacagcttgaaatttgaaaccttttgaaaatgtaaggatgaggccgggcgcggtggctcatgcttgtaatcccagcactttgggaggcctagaggggcggatcacgacgtcaggagatcgagatcatcctggctaacacggtgaaaccccgttactaacaatacaaaaaaaagttagccgggcgtggtggcgagcgcctgtagtcccagctactcgggaggctgaggcaggagaatggcgtgaacccgggaggcggagcttgcagttagccgagatggcgccattgcaccctagtctgggcgactgagcgagactccgtctcaaaaaaaaaaaaaaaagaaaatgtaaggatgagtagaaaattctgtcatcttgagaaaagccaagaaaataatgaagacacgttgtcttcaaaaatctctctcaactgtgataggtttcaagtagaaaggcttgtttaaaatattctgaaaaatttttcagaattcatatcataattatcactgcaatatattgatctagatttttcataaggagctcatgacatcaaagagcattaaacacactatttctgtgcacacctggtaaggtgaggtgcaaggcttctagaaaaaagctactatccaactcagggttcacagtgccccagcttggaccaaactttctctaggaataatagtgacattagggaattctcagtgagtaacactgtaagattttggattttaacattttatcttttacagcagatcaatcatcacttttcattaataaaacaacctttgtatttttcgtccattgctttcaaattaggatagtcaatgggatctcactgttctgtccagtggtgccatttgctagaagaataaatgattgttgaagagctgctaaaccaattgggcagcctaaagataataagcctctgtgaactaaccataagtcacaataactctgcactttgtcgaaagagccacaatcaatggtcagatcaaaatgcatattcccatagtacacaagagaaggaaaggtgcggatgggatgcctttggcttaaaaaatagtttactgttttctgattacaaaaaaattatccacaaaatagtaaacatattagtacaaaaagaaaagtatccataatcttactacccaaaggcaacattgttaacatgtcgttatatttccttccacacttttttaaagcgtattttccctaattgagatcatcccatagatctaattttattgtctgcattttcataaaattataaaacacattttctcactcttcacatgagtaattttaatggccacataatctttcatcttacaggtgtaccataatttatttagaaatcccttttattattgaacgtatacggtgggatgttttgtttaattttggttttttcttaatgaagctgtgtaaatatctttggctacaagtaatctttgagcagaaactcttgatagggtgggaacacttgaatacaaaaaaaaaatttctagtgtctgtcatcagactatcaattctatctcactttcttcattcaactgataatattaattcactgaagtagtatataagactccaatgtagaaagctacaactgattacctggaataaaactggaatatcagatcaaatacttattgcattttcatttgtctattggataactttacagctttatttgtctcctactttgaagataactttggctcaaatgcaaagaggtgccaacattggtgaatatctagcaatgtctttattcatggctctgcttcctgactgacatcctctgctttctcattttcaggtttaagatgtttttctttcttttttcttgttttcttgtttgggctacaaatttattttttcacattgatttttttgtaatttttaaattttttgtgggtagatagtaggcatataattatttatggaatacatgaaatgggaaaaatgaattcctagaaggggattgctggatgaaaggatacatgcatatgtaattttaataggtgatgccaaatttccccccttagcggttgttttatttttcattttcaccaccactatattagagttaattttaattttgttacttcactcattaaggagtcactacagtataaagtccttccagattcacagtaatgaacaagatatggaggtagctatggaaaacatggacgccagcttgtgatggtagccaagattctggaggcctaaatagagagttaagcaccacttcttaaaataatttcatggactggaagagttaacactgttaaaatggcaatactcctcaaattgacctatagattaaacgtccatcaaaattcaaactgcctatttgggggagaaattgacaagctaatcctgaaattcatatgagaatgcaagagacccaatagagccaaaaacaatcttgaaagagaacaacaagattggaggagtcacacttccaaatttcaaatcttactacaaacctacagtaaagacagtataatactggcataaggacagacacagatcaatggaacagaactaagaacatagaaataaacctatacatctacactcaattgatttttgacaagaatcccaagaccactcaatagggaaagaaaagttgtcttaacaaacagtgttggaaaaactggatatccatgggcattaaaaaaaaaaaaagttagaccactacttaataccatacaaaaaattaactcaaaatgtaacaaaaacataaatgtaagcgctacaactatgaaactctcagaagaaaacataggagtaaatctttctgacttttttattaggcattgtttcttagatacgacaccaaaacccaagcaaccaaaggaaaagtagacaaattgaacttcatcaaaactaagcttttgtaaacttttgtgcttcaaaggacaccatgagtgaagtgaaacgacaacctataaaatggggggaaatatttggaaatcatttatctgataagggtctattaagcagaataaagagcccttacgactcatcaacaaaaggacaaataaccagcttgaaaatgggcaaaggacttgaatggacatttctccaaagatatacagatggaaaataggtacatgctcaacatcattagtcattagggaaatgcaaatcaaaactacaatgtgataccacttcacacccacaagaatacttgtaattaaagaaagaaaacagaaaatacacttggtgaaaatgtaaaggaatgtgaatcttcatatgtgctagtgggaatgtagaatggtgaagcctctgtgaaaaacagtttggcaatacctccaaaagttaaatacagagttaccgtatgacccagaagttctactcctaagtacatacccaaaagaatctcaaacatacagtcacgcatcgcttaatgctgagatacattctgagaaatgtgtcattagatattgttgttgtgtgaacatcatagagtatacatacacaaacctagatgatacagcctactacatacctaggctgctatgtaatagcagtaatgttaatgattttcatgatctgagaggcctgtgcttcaaaacaagaagtctcagtagtgggccgggcacagtggctcgcccctgtaatcccagcactttgggacgctgaggcgggcggatcacctaaggtcacgagtttgagatcagcctagccaacatggtgaaaccccgtctctactaaaaacacaaaaattagcccggcatcatggcatctgcctttaatcccagctactagggaggctgacgtgtgagaattgcttgaacctgggaggtgtaggttgcagtgagccaagattacaacattgcactccagcctgggtgacagagtgagactccgcctcaaaaaaaaaaaaaaaaattaaaaaagaagtctcagtagtagaactttcaaccacaaagttagaatcacttcatgggtgtccatcaccataccatacatttgaagggcacactatctttttgtaaaagcctaaaatgagacaggatgggatcaaactccctattacttctaggctgcaaacctgtaaagcatgttactgtactgaataccataggcaattttaatacaatggcaattatttttgtatctaaatatatctaaacataggaaaggcacagtaaaaatatggtatcataatcttatgagactaccgccatatatgtggtctgtcattgactgaaacgttatctggtacgtgattatatatgcaaaaacttttatgtgaatatttatagcattactaatcataacagccaaaaggtggaaacaacctacatgtgattaactgagtgaataaacaaaatgtagtatgattaatggctacaaaaatacagttaggtagaaagaataagttctaatgtgcaataacacaggagggcaaccatagttaagaatttatagtatatttcaaaatagctagaagagaagatttggaatgttcccaatacaaggaagcaataaatgtttgaggtaatggatacccaattaccctgatttgatcattacacattgtatgcatgtatcaaactatgccgtgtactccataaatatgtacgactattatgtatcaataaaaatgtagatcaatacaatgaaatactatttggccataaaaaggtatgaagtactgataaatgctacagcatgaatgtgcctttaaaacattatactaagtggaagaatccagacacaaaagtccagatattgtataatttaatttctataaaatgttcagaataggcaaatccgtagaaacagaaaatactttagtgatttccatagacaggaggaggaggagaatgggaagtgactactaatgagcatggggtttctttttggggtaataaaagtgctctggaattacatagtggtaaaagcggcgtaactttgcgaatacactaaaaacaaatgattgtacaccttaaaatgctgaattttatgatatttgaattacatctcaattaaaaagccttttttcgtgttactgttttattctggatatctaaacatttccatatttgcaatactaatctcccttttgcaaagtgttgacacaataggtgagtttgaataatgcgtagtagatttagtgaatatggcatacccatttgcaaaggaccattacataaagatcttaatgcactctgtgtcttcataacatttgcttcagatccattatagtgaagttgaactaatgatgattttgttaaaagcctaaattgaatgtcatccagaagcaaggtgcttcccccaaattattcttagaatggttgtagacaaaatactgtagtactactacttagatacaatgtaaaatattatacaaataactgcccttctggagtttgcgttatcttaggttgcataagataaaaatttttcctcctatgagtctcacatattcaaattgcttaatcatatcagcccctgcttaaacactgttaagaagctcatattcactctgatgaaatacatatacttcaaactaacacacaagatcactctttctgtaattacccaccctccctattacctctcaatgcaccctatttcagctctactaaaccatataatactccctaatatgttactgaatatccgtgtgtttgtgtacatttagttccctctgcttaaaatgctacctatcacctacacactctccagaaaatcaatttcttctctagtatgcttttggtgacttctctgccatcttcctacccagtgtgagctctgtgttcccatcacgccctacacccatcacagtactcttcgcattgtattgttgttatttgttcctaggtctgtgtattaatttgggtattgcaactataatagagaatcctaaacatttcagcagatgaaacttattatttgttcatataacagtctaatgcaggtctagttagtggggtttagggacatctgttccaagcaatcattcaaggatgctctggctaatggatgctctgtcatctctgaagcaaagatctgctaggatgtcaatatccagtttggctaagagggaagagagttagaaggagacatatccttcatttaactaccttggcccagaagtgatacaagtcacttctgcttaccttgcattggcaaacatttgtcacatgatctcaccttaatataagggagttggacaattctctaccacggaaggaggagtatgaattttggtggaaagttagccaatcctgtcagtctatttcttccattaaacatggaacctttgaaagtaggaggcattcctcattcatcctaatagtctcattcatctgccacataaagcatagatatagtagaatttgtaaaatgttcatcaacgtgttactattttttgtgtgcctgcattacctttatttgttttaccacaattccccagccttcaaaccagatcttcacctctgtgttctaaggaaagaagatcaattcagtaaagcaaaaaaaggtgaaaggcgggaaaaattctgaataagactgtggactgcatcagtttcaatatcttcttgtgatacattatagttttgccaagatattaacattgggggaaactgaatgaagggcacatgagacctcttggtattatttcttacaactacatgtgaatctacatgtagttgtaagtacatgacctcataagtatttattagatatttgcttcttacaactatatgtgactctacatgtagttgtaagtacatgacgtcatgttttaatttaaaatgtggctaaatactaggacctaaaaataaacaaacaatggatgttaatttctgacttttgcgcttccaaaaactaaagtcctggtataaataatgtgcttgaaataacactccatatgatgatatttaaaatatgtttataaattctttgatgctttcctcaactcaagtggagcctaactgccttccctttgaatacagactgatcttactgtctcacttctaataaatagaatgcaatagaattaactgcggtaggtataatgtcttggaagatccccacacctaatctctgtgacctgcggatatcttaggttacatcttaaagaggtctatgcaaatgtaattaaggtcacatactttgaaatagagaggttaccctgattatctgagtaggccaatccaatcacaggagccctcaaaacagagaactttctccagctagagtaggacagaaaaggcagagagagagaggtcagagatattcaaagcatgagaaggacttggcctgccatgactgggttggaagatgaaggggaccatgagtgagggtatgtgtgtggtctttagaagctgagaataacctctagctaacagccagcaacgaaacagaaaccccagccctacaactgcaaggacctaaagttggccaacaacctacatgatctcgtaagtagatttcccccagaatttccagccttcaggctggctgacaccctgatgtaagctttatggacaaggagtcgaggaaccagccatacccatctggacttttgacctatggaactgtgaaataataagtttgaattgtttaagtcactaagcttgtggtaattagatatggtcacaatagaaaatgattacagtaacgcaatatgacttccaaggctagatcataagaggcagtacagtttccacctggagtgtctctctctcctccctccttcctctctcctctgccctgagcaaccatataagtatggctaacccaaaaccaccatactggagaaaccacgtggaaggatcacatagagatagagataccccagctgttttacccctaagctgtttgcatttctagtttaggtaccagacatctcagaggaagcttttgatatggctgtagcctcagccaccatcagactgagagaaccccaagtaggaatcacatagtttagcccaatcaaccatcttaactataagacattgatgatgatgataatgatggtgatgatgatgatgatgatgataaaatgattgtttcatgaaactaaaactatgaaactttgtggtggttcattaaaaaaaaaattgaacacttctttagcttcttgttgttcctccatagagaggagattaaaaactttctctgtatgaatgagggaggagctgaatcacagagaagtggatagaaaatcattagaacaaagtgctgatatgggccttcactctttacttctccggtagggatgaggaaaaaataggaagtacttgtccccaactttttacctagaaaagggttcagcaaacttttacttcaagggcaagatggtaaatatttttaggcttcacaggataagaagcaaaatcaagactataacgtagcaacttatacaccatttaaaatataaccatttatttgtattggacaaatatatatactaaaatttgtattttttttttaaaaatcatacttccttgctttccaatatctcactaaaagcagtttgctcttcaacaaacaccgtgtttctaagttctgaaatgggagtatatttgattgtgtatacaaggactgtatgatctgattttagccagtctgtatgaggcctgcttctctttgcagttgtcttctttgacttgaaaattgccagataccttgactcaaactgagcagaaacgtgctaaattgaatttgaaacagaaagggtgaatttttcccgtgccttcccaattattttgcacatgatgtcatttctagcataggggaaagaaacctaggtttcaaatcacgagatttgagcataaggcactttctagttgcagtaccacgagcatgacagttaatatgtctgagcctcggcttctgtaagccgatgggattaataactgcctgctcacttaacatgggtggttgcaattcaaatgagataaagaatataaaggtgaactgcaacttcaaagtgtatgacgcttgctaattgttactgatgtgtctattacaaaggatttggtctccctggctggcccccctgccctccctccctccatccttccctcctttcattccttcctttcttccttgcttcctctgttcctctcctccacctctctacccacctcactcaacatggtagagatttaggatctgtggcacatgattatggaaggtgtcttatgttagtagggccttttagggcttatgttagccttttatccatacatgtattaattctccaataattatgagtacccgctcttagagaggcactatatttggtgctgtagatatagtagtgaatgagacagacaaggttcctctctcatagatcttaagctccaatgaggagtattattagttttctatgactgctacaacaaagcacaataaaattaatggcttaaaacagcataaatgtattatcttttagttctggaggtgagaagtctaaaacagatccacagggctgtgttcatttgggaggctctagggaagaatctgttcccttgtcctttacagcttctagaggctgcctgaattccctgaccgacggcctcttcctctatcttcaaagccaggaatgtggcatcttcaaatctctttctctccgttcctctgcttccaccatcacatcaccctctgtctgactgtgatccccctgcctcccttacaggaaactttgtgactacactgggtgcactcagataatctggggtaatcttcccagatcaagatgcttaacttaatcacatgtacaaagtccctttttttcatataaggtagtattcacaagttctggggattaggaggcacacattctaggtggttattatttagtccacccgagggaaagagagaaagtaaacaggcatacaaacagataagaatttagagtgtgatttgtgctgtgagggcaataaatagcagctgcaccatccagtgtggtagctacaagcaacacgtggctattgggtacttaattgttttgtgaaatttgtagatttccttgatgttttgaataagatataaaagtttgtaagcatcttcaatattctagccatctctttgcttaatcattttgttttattaaacaagcaatctttggtcacttcctatatgctgggggtaactgagaaaacacacagcctctacttccaaggaaggttccatcaaggaaaacgagaagttgttaaaaaaaaaaaacatactaaagataagcatgtaaagagtgttgtggagcatatttggcagattttatgcatgaattttaattttaagaaattgacagagaaaattgtatgtatttaacatgaacaacatgatatatttttttttttcttgagacggagtctcgctctgtcacccaggctggagtgcagtggtgcaatctcggttcactgcaacctccacctcctaggttcaagcaattctcctgcctcagcctcccaagtagctgggattacaggagtgcaccaccacactcggctagttttgtatttttagtagagatgggggtttcaccatgttggtcaggctggtctcgaactcctgacctcaagtgatccacctgccttagcctcccaaagtgcaatgtgatgtcttgaagtatatatatattgtggaatgactgaatctagctaattaacatatgcattaccccacatagtcagcactttcgtagtgagaacacttacccactctcttatcatttgtcaagaatacagtatagttattaactatagtcacattgttatacaatagatcttttgaacttattcctcctgtttaactgaaattttgtatcctttgaccaacaactcctcaatatcactccccagcccattctactctctagctctatgaaatctactttttaagattctacatatgagtgagatcatgtggtatttgtcttctgtgcttggcttatttcactaaacataatggcctccaggttcatctatgttgttgcaagtgacaggtttcctcctttgtaaaggctgattaatattctattgtgtgtgtatatatatacacacacacacattttctttatccattcttctgttgatggacacttagcttgattccatatcttgtctattgtgaatagtgctgtaataaacaatggaatgcagatatctctttgacatacttatttggatatatatccagtaatggaattggtggatcatgtggtggttctgtttttaatctttgaggaaactccatattgttttccataatggttgtacaaatttacattcccaccaacagtgcgcatgagttcccttttctctacatcctagccaaaatctgttatcttttatctttttgatcatagccattctaacaggaaggaagtgacatctcactgtggttttaatttgcacttccctgaagccacacaagatgttgagcattttctcacacaccagttggcaatttgcacgtcttgttttgagaaatgtctattcagctcatttccccatctttcaactgggttgtttacttgctattgagttggattcctgatatattttggatattaatgccttatcagatatatagtttgcaagtattttctcccattctgtaggttgtctcttcactctgttgattgtttcttttgctgtgcagagctttttagtttgatgtaattccatttgtctatattttgcctgtgcttttggtgtcatatccaaaaaatgtttccccagaccaatataataaagcttttccctatgttttcttctagaattttcatagtctgggatcttacatttaagtcttcaatatattttgagttgtttttctatatggtacgatttagggtctattttcattcttctgcatatgggtatctggttttcccaactccatttattgagggactatcctttcctcagtgagtacatttggcatcttgtttttttttgctcaagattgctttggctctttggggtcttttatggttccacataaattttcaaattgttttttctatttctgtgaaagatgtcattggtattttgatagggattacattgaatatgtagattgctttgggtagtatggacattttaacaatattaattcttcaaattcatgaaaacagatatctttccatttatttgtatcttcttcaatttctttcatcaaaggtttatagttttcagtgtagagatctttcacctccttgattaaatttattccttattttagcgattgtaaatgagattgttttcttgatttcttcttcagataggttgctgttagtatagacacactactgatttttgtatgttaactttatatattacaattttactaaattcatttatcaattttaacagatttttctggagttgttagagttttctatatataagatcatgttatctgcaaacaaggacaatttaacttcttcctttccaatatagaaggcttttgtttctcttgcctaatttgctctggctaggctattgagttctttaaatggagctagtgtgactgaggaactgagtttttatttcattttaattaatttagatttaaattcagatagccacaagtggttaccataatggacagtctagctttaggctttttgaagccacacaagaaaatatttcccctcttttcagcttagctgaattgcatgactacccatgaaaatagccaatacccatcagctttaataaatggaatgaggctagtcaggtgaacaactagatacgttttcctgcactggccaaaaagaaatactccctattactatagcaatcatctagtcccaatcagagaatattccttccatttggagggaaaagtagattgggacactgctcataatacttcatttccttccgtatatatccacatactttccctgtcttcaagatcggctgagtgtatttccttagctcctgactttgttttggccaatggagtagtaacagctatgacagacacatgggctttaaatttgcttacatgtctgtgtttagcctcttgtagaacaggggtagaacagcctatcccaggtagcctctggtccaaggaaaatgtggcaacatgggaatacacctgaattaaacctggagactgatacctagagcatggagtccatcctagcctagctgaggtagagccaatttgcagactttaagccacagaattttggctgaatttgttactcagcattgcagtagcatagctaactaatacaatgggcactatcagaaggatttctcctttctaggaggactttacacatttctagaagaggctgacttagctcccgtaattcttccgagctctctgtggtttttccatttaacgtggggtagttgacacgggattatttgctttcaaagcagttttttttcagtagtggtaagaacagggagaccttcaaagtctaaggatttgtgtaacagaaattgcacagctcagtgagcaaagcaactgagtggaacccttctctcaaaaaaggtctatttctggcttcaaagacacaactttctccttctagaactccccatcttgtaggctgttagcgggaaagcaaataaaatatcactatctagctttccttccaaagtaagtgtgatgaaaaacaaagatggaaatgtcttttaaaagcccagagtactttaaatatgtgactttaatttcagtagctagagttgctaaaagtaaacctggtaatgcctctccgatggaccttctcttctaagtgactgaggcttagccatttcacctgttgtttctctgcatgaagaaagttgagtcaggttttttttcgttgtgatttttgccaccttctgagcattaatgatgctggaatactagtctactcttcccccaggtgcattgattttcctgcttgaattgatgtagtcccacaaagagaacacctcactgttattatcctttcggatgctctattcgctggctcagccaccctgctcagcttaatgaaaaatagactgtgttgatggaagaaaaacagtttttcagatctaagagacttcctgagcttgaagcatgagaacaggcacctattcaaaaactaagggagccagatttcaaaaatttaatatagcaatcaacaaaattatcagtgggacagtgaactatagactgtaagatttaaaactctgcttgcttatatatatgcaggaaaacttgcttcctatatgtttgagtctgccaacaggggccaaaaacatcattattgcctatattttctctattttgtatgaggatattctctgaggaaggcattaaattggctcagacaattaccaatagccacacatggaagtttggctccttcctctgtgctcttgttgcaattattcaactcagttatattattgctacttgtaatatatgtctagaaccttctcgccaggtcaggggtcagccaggctatcatggtcctttgggtctaggactaatgaagtaatcctttctcctgaagcctcagggctgaaatcaagggaagatgtatagctgagttgaataagaagctgagtctggtaagccagagaggtcaaattacagcagatggttaaagccaaaaggccagagcaggtaatggtgggggttcagtgacagggagaagagaaacccacttcaagaaagcaaggtgttatcccaggcaattcttggaacaggcatggttgtcagaagctggcacctatgtgcccaaaggagagtattatcaaaaagagccagctacaaaggtcagagatagggcctatcccccaagtctctctctcccacaaggctgtgagacccctgaggaagctcttacctaattcctccttatgcctctagtacatgtcatataggaaccaaataaattttggcagcgcgaaaaaaataattgtcgagattaagcagatatgcagtatttctgctaatataactattcacttaagtcaagttatacaaagagattattaagttctgtgagtaaagtttcatttatataattagttgcattttgtgtaatcgaagaacggaaaacacagaatttaaaaggtacaatgcatcatttttgaaagaaaaacactgatcataggcagagttttctggtaggaaactcagtatatgcttttaaagaggctactgctattctctggagttactaaaatttgtggttcctactgccctgaaaagaagatggatttaaaatgtaccctttaggttcttcttagagagaagcactttgaaaggagaaaacaccacataagtgtcaaatcttactattatcaccacttctgcgaatacctccaagtcacgggaaaacgttcataaaaggagtctgctttggagataggctgttgagagaagttcatctgagatattccacgcacaagctgcctgcatttaatgccatctccctgaaatcccaaattactactgtcaccactttgtgtagtaaaactttcaggtaaataaaaagcaaaatgggaagaaagtattaaatgcttttacagtggactaatgaaaacaatcccagagcattatttactttcatggtaaatcatagtgtgaaaaaaaaaaaaacagtatacattcctgttactgaccactgtcactaaacaccatggaacactggctctttttatcctcttcctataattacagaaagcctaaaataaatatttctcatgtgaatgtcagttctactttcagcctccaggttttctagaactgctcaaattctcatgcccatattcctatatacattcctgatatgtttatacacacatatttagagtaggggttggcaaactacagcctgtttttgtatgtcccatgagctaagagtggtttctatattttaaaatggattttgaaaagtacaaaaaataatatattatgacaagtaaaaattatatgaaatttaaacgtcaatgcccatgcatcatgttttactggaacacagtcagggtcatgagtttatgtatcattcatggctgcttttgcgctaaaaatgaatagctgtgattgagatcctatctgtcaaagccaaaaatatttactctctggccctttacagaaaaaaattgccaactcctgatctaaagcatacttatggctccttttaaaaaattgcttttttgtggaagtataatgtgatacttcaagaaagggcaaagggtacaaactctatgaatttttacatacgtatttacctgtgtgactcccacccaaatcaaaataaagaacatttccagcatcccaaaagtgttcctctaagctgaagttatccatttttctaagatctatcactcatgaattgattctatttgtttctgaaatgtaaatcaatggagtaatgtagtatttcaaatcaatggagtaatgtattttttggtttggcttatttattcaacattatgtgtatgaaattcatgttgttgtacgtgacagtagtttgttctattgtatgaatgtactatatattctactcttgttggatattgggtagttttcaattgtgggctattatgaatacagcttctatgaacatttttgtatacgtattttagtgactataaatactcagctctcttaagtatactcctagaatgatgctcctaggatgctgatccttttttaaaaaaaaaacagaactacaatttgctacaagcaaggtacactcatagaacctttaaaaaatataaagcaaaaacatttttggagacgcatactaaaatatttaggggataacttgtagagtgtcatttaaaaggctatggcaattatctagaatctacaagaaacaaataaataagcaaaaaataaataatccaatttaaaaaatgggccaaggacacgaacatatacttctcaaaagaagatgtacaagtggccaatgaacaagaaaaaatgctcaacatcaccactcatcagagaaatgcaaatcaaaaccacaatgagatacgatatcacatcagttgaaatgatgatgattaaaaagtcaaaaaacaagaaatcctgggaaggctgcagagaaaaaggagtgcttatacactgttggtgggaatgcaaactagctcagccactgcggaaaacagtttggagatttctcaaagaacttaaaacagagctaccatttgacccagcaatcccattactgagtatatactcaaaggaaaataaattgttctaccaaaaagacacatgcacttgtatgttcatctatgagccattcacaaaagcaaagacatagaatcactgggcaacccaggtgccaatcagtgttggattggataaagaaaatgtggtacatatacaccatggaatactacgcagccatacaaaaaggagatcatgtcctttgcagcaacatggatgcagctggaggccaatattctaagcaaattaaagcagaaacagaaaaccaaataccgcaagttttcacttataactggaagctaaacattggacataaagatgggaacaacagtcaatggggactacttgagggctcagggagggagggggatgtgggctgaaagactacctattgggtactatgcccactacctggataaaggggccatccacaccccaaacctcagtatcacacaatatactcatataataaacctgcacatgtatcccctgaatccagcattaaaaaaaaaaaggaaactgaaactacatgacaggtctcttagagttcatttcattgtactctattctttagtgcatttggaaactttcccaataaaaactggaaaaaagaaacaggttgcagtaaataatgaagcagatctactattatactacccaactagaatgctagacattggggaaagtttcagcttcagtaactgtgacgagtcctgtattttctagcaggtgaacttgtttatcatgaaaataattggtgatatccagcataaattgtggggacaaaaatagaatgaaatgggagaaatttcacatctagagcttgccagatacacattcttaggcaatgtatttacctttgtctgcaaaatgagaattcctgtacccagaattactttggggattatatgaagccagacaggtatgagccttttatttagcatctaacacatgagaagcactcaataaatgttgtttaaaattatgcctattattcataggctgaaagggagttcaatttctggcaaactaatgacactcactgaaaacaattagaaaatctgaaaaaatattaaaaggctctatttgaaggcataggagaaccatgaagatgcaagtattagtggcactaagattctatagagaggaaaagccagagaagtgagcctggtgtttagtgctgctttttgcctcgaggcctttgaaaattccaaaagcagtggctaagagactgagagatagcactgagctttcaatagactcagagggatcctcagtcaaaagtttgagttctacacgggaggctggggtgggaggattacttaagcctgggaagtcaaggctgcagtgagccatgatagtgctactacactccagcctgggcaacagagtaagaccctgtctcaaaaaaaaaaaaaaaaaaaaaaaaaaaaaagaggttgagctcaagaccactaataaggatggttcctgccatataatatactccaggatttctgttagaattctaaagcactacactctaattgggaaatggaaggttccagctctcagagacactgaagcctagttttggataatattctctgattgaattaagttactctgggattcctagttcccctaaagtacctgcctgatggaggcaaaataaaaataaaggcactctggaggaagaatacatcatccagatccacaaattatcgcttaatttttctcatataaaacgttgaacacacagtttaaaaacaaccagatgtataagaaggaaaggtttgatcaaaaaccaacagagaaagcagacaataaaaacagactcaccagaggtccatataatgggcatattgttcaaggatttcaaatatacaattgttcaaaggatttcaaatacacgattgttaatatattcaaagaatttaaagaaaatatgggtaattttggtagctagttaaaatgggaattatagaaatggaaataattaagattaaaagctcaatggattgttttaactgaaaactggatgcaacggatagataattacttaactggagcttggatcagaataaaaatatccagaatcaatcagggaaaaataaaatgtgggattatacagaaaagagcattagagactttagggacacaataaaaaggattcccagaaagaaaggggaggaagaatggtcaaagactgttacagagataatgaactaaaatttcccaaaagtgatgaaagacatcactccacaagctgaatacatagcaagaaaacaataactaaatactttatactacaacagttaacaaaaggaagtagaaattaaaagaaaaatgatatatccctatagacttattttaaaagattatttttttttcaataggttttttgtgaaacaagtggtgactggttacaagaataaattctttagtggtgatttctgagattctgatgcgcccatcaccctagcagtgtacactgctttacatttctttttatggcggagaagtactccatggtatgtatgtgtatatatttttggctaatctcgctaatggtctatcaattttatttatcttttcaaggaaccagatttttgtttcatttatcttttatcttttttatttttgttgttgttgtttcaatttcatttagttctgttctgatcttcgttatttcctttcttctgctaggtttgggtttggattgctcttgtgtctccagttccatgaggcacgaccttagattgtctatttgtgctctttcagactttttgatgtagtcatttaatgctatgaactttcctcttagcactgcttttgctgtatcccagaggttttgaagggttgtgtaagtattatcgtgcagttcaaagaattttttaaatttccatcttgatttcattgttgacccaatgatcattcaggagcaggttatttaatttccatatttttgcatggttttgacggttccttttggagttgatttccaattttattccactgtggtctgagagagtacttgatataatttcgattttcttaaatttactgagacttgtttgtggcctatcatatggtctatcctggagaatgttccatgtgctgatgaatagaatgtatattctgcagttgttgggtagaatgttctataaatatctgttaagtctatttgttgtaggatatagtttaactccattgcttctttgttgcttcctgtcttgatgacctgtctagtgctgtcatggagtattaaagcccaccactattattgtgttgccatctatttcatttcttaggtctagtagtaatcgttttgtaaatttgggagctccagtgttagatgcatatatatttagaattatattttcctgttggactaatccttttatcattatataatgcccctctttgtcttttttaactgctattgctttaaagtttgttttgtctgctatatgaatagatactcctgctcacttctggtgtccatttgcatgggatatatttttccaccccataccttaagtttatgtgaatccttatgtgttaggtgaatctcctgaagacagcagaaacttgattggtgaattcttatccattcttctcttctgtatcttttaaatggagcatgtaggccacttacattcaatgttactatcgagatgtgaggtactattctattcatcatgctatttgttgattgttataataagtccggtgcgacttatgctataaggaggttttattttggtaaattttgataattcattttaagatttggagctccttttagcagttcctttagtgctggcttggtagtggcaaattctctcagcatttgtttggaaaagactatatctttccttcatttgtgaagcttagttttgctggatacaaaattcttggctgataattgttttctttaaggaggctaaaaataggaccccaatcccttcttagtttgtagggtttctgctgagaaatctgctatgaatctgacaggttttcctttataggttacctcacgcttttgcctcacagctcttaagattctttccttcatcttgactttagataacctgatgactgtgtgcctaggcgatgatcattttgtgatgaatttcccaagtgttctttgagcttcttgtatttggatgtctagatctctagcaaggccagacaagttttccccaattattccctcaaatgtgttttccaaacttttagatttctcttcttcctcaggaacaccaattattcttaggtttggatgtttaacacagtcccaaactttgtggaggctttgttcattttttaaaaattatttttgctttgtctttgatggcctgggttaacttgaaagccttgtctttgagctatgaagttctttcttctgcttgtttgactatattgctgagactttccagtgcattttgcatttctctaagtgtgtcttttatttccggaagttgggatttttttttatttatgctatttcactgaagaattatcctttcatatcctatataatgtttttgatttctttaagcttgacttcacctttctctggtgcctccttgatttgtttaatattcaactttctgaattctttttctggaaattcagagattttgtcttggtttggagccattgctgatgagctggtatgatcttttgagggtgttaaagaaccttgttttatcatattaccagaattgtttttgtggttccttctcatttaggtagattatgtcagggggaagataggggattcaggggctgctgttcagattcttttgtcccacggggtgctcccttcatgttgtgttctctcctttcccctaggaatggggcttcccgagagcctaactgtagtgattgtttttgctcttctggatctagccacccggcagagctaccgagcttcaggctggtactggggagtgtctgcaaagagtcctgtcatgtgatctgtgttcaggtcttgctgccatggataccagcacctgctctgggggaggtagcaggggagtgaagtggattctgtgagggtccttggctgtgtttttgtttagtgtgctggttttatgatggttgatctccagccaggaggtgatgctttcaagagcgcatcagttgtgataatatagggaggatgcaaacttgccctagtgcccaagggagcatcccgtgggacaaaagaacctagtattcaggtttctcagtcggtgggcagggccacagagctcccaagagattatgacctttgtctttggctaccagggtggggcggggttaggtgtgtctgagctcagcctctcctagcgtggggcttgctgaggctgctgtgaggatgggggtgtggttcccagtggaatggatttatattcccagggggattatggctgtctctgctgagtcatacaggtttccagggaagtgggggaaagctggcagtcacaggtctcacagagcccgcagtcctaaatgccagtctcactcccactgtgcccctgcaatagtaccaagtctatttttagacagctagtcaccagggctgagatctcgccccaggccatgagacagcggcctgccgcaatgatccagttccttcaaagcatctgtggatgctctcagctttcctggtatattcctgtggtatttcttggagcataagttcacgatgtgagtctccacatgctgctcttgtccctctgaatgggagctgcaagctaatcctgcctcctatctgccatctgaatccctgctagtgctccactatagacttattagaatgactaaaatccaaaacactaacaccaccaaatgttggtgaggacgtgaagcaaaaagaacttcattcgttgctaatggggatgcaaaatgatacacccactttggaagacagtctgacagtttcttaaaagccaaacatagtattatcagacaatccagtgatcatgctccctagtatttatccaaatgaaatgagaactcatgtctacatacaaacctgcaatgaatgtttacagcagctttattcatcattgccaagatttggaagcccaagatgtccttcgataggtgtatggataaacaaactgtggtgcatccttacgatggaatgttattcagcactaaaatgaaatgagccatgagaagatacagaggaatcttaaatgcatgctgctaagtgacagaagtccgtctcgaaaggctacatactgtatgactccaactctgtgacatcttggaaaagtcataactatagagatagtaaaaatatcaatagttgccaggaatttgggtagagggagggagggacaaataggtgaaacacggggaatttttaggggaattaaactgttctgtattatccaaagtaagaaaccaaactttaaaacaaaaactatatgatgatcttagtaggtgcagagaaagcatttaataaatctaccattcattactggttatttaaaaaaaaaaaaaaaactcatcgcaaaatagaaatagagaacttcctcaaccttatacaaggcatctatttaaaaaacactacagctagcatcatagttaattgcaaaaccctgaatattttattctaagttcaggaacaaaacaaggatgtccattctgcattcaatattatactggagtttccagccaatgcaatcaggcaagaaaattaaataaacagcctctagattgtaaaaaaaaatagtaataagtaaaactgtctttattcatagaagtcattgttaatgtagaaaagctgatgaaatttacaaagaagttattagaactaaaatgtgagagtagcaagtttgctggtacaagatcaatatacaaaatgtttacgtatttataataaaaagtcagaaattaaaataaaaacaataccatttaaaatagtatgaaaatatgaaatattttaggattcatgtgatgaaatatgtaaaagatcagtacaatgaaaactacaaaacactgttgagagaaataaatggagatctaaataaatggagacatgatactgcctttatgggtcataagacttattattgttatgataccaattctctgcaattgatctacagatttaacaaaaccccatccaaaactgtagcatgctctttggtgcaaattgacgagcagattctaaaagtcacagagaaatgcaaaagaccctgaatgagcaaaacagttttcaaaaagaagaacaaagttgaagagctaaaactacctgatttcaagacttatgagaaagtcttagtcatactataattatgtcagaccgtgtaacattactgcaaagagagacaaacaagtaagtggaataaagtccagaaagagacccccacactcgaactaatttttcacaaagttgcaaggcaattcattgtagaaaggattgttttttcaataaaagacgttggagcaaatgaatatctgtatgcaaaaatataaaattttatacatatcttacattatatataaatattaactcaacataaatcatcgacctaaatctcaaacctaaaactgtaaaacttgtaaaggaacacataggagaaaagctctgtgatcctgggttaggcaaagacttcttacatcgacaataaaagcatgatccatgaaagaacaaactgatacactggacttcatatgcatgtatgtatataacacagtctatcaactcacccattgagggacttttatgttgcttccacagcttgactattatgtgtaatgctgcaatgaacatgggagtacaagtatctctttgaaatcctgatttcaattcttttggataaatattcagtagttggattgctggatcatatggtagttccatttaaaattttttgagaaatcttgatactgttttccatagtggctgcaccgttttatattcccaccaacagtgcacaaggattccaatttatccacatcctctccaacactcgctactattgtttttgaaaataatgttcattctctatttttaaagtcaaaaaaataacagatgttgccaaggctgtggagaaaggggaatgcttatatactgctggtgggaatgcaaagtagttcagccctagtgaaaatagtttggagatttttcaaaaaactaaaaatagaactactattcaactcagcaatcccattactgtttttttttccatttatatattaacatcaggcaatttattacaaaacactatacactttctactgcagctgtgttatttattgacagcaaatttctgcaaataagacagtgaatatattatccactccatgttgattaggaaaagtttttctagtttcagagtacatacccaaaggaaaagcaaagttctaccaaaaagacacttgcacttgtatgttcatcatagcactactgacaatagcaaagacatggaatcaacccaggtacccatcaacagtggattgaataaagaaaatgtggttgcctgagctcatcagttcaagaccagccagggcagcatggtgaaaccttgtctctactaaaatgcaaaaattagcctggcgtggtggcatgtgcctgtaatcccagctactcaggagcctgagacaggagaattacttgaacctgggaggcggaggttgcagtgagccaagatcgtgccattgcactccagcctgggcaacaaagcgagacgctattaaaaaaaagaaagaaagaaaatgtggtacgtatacaccatggaagacgatgcagttatataaaagaatgaaattacgtccttcgcagcaacatggaagcagctggaagccattattcaaagtgaattaatgcagaaacagaaaaccaaatactgcatgttctcacttatatgtgaaagctaatcattgggtacatatggacataaagatggaaacaataaacactggggattccaaaaggtgggaaggaagtaagggggcaaggattgaaaattccctgtcaagtactatgtttactacttgggcaacaggatcactagaagtccaaacctcggcatcacatggtatacccatgtaacaaatatgcatatgtaccccctgaatccagaataaaagaattttaacaaagaaaagaaatggccatcctaccatgtgaggtgatagctcattgtggttttgatttgtattttcctgataagtggtgttgaacatcttttcatatgctagttgaccatttgtacgtcttctttggagaaatggctactcaggtcctttgcctattttaaaagtggattatttggtttttctgctattgagttgtaggatatccttagcagttagatattacctacttatcagatacgtggtttgtacattttttttctactctgtaggttgctttttcactctgttgattatttccttaatattatttgtttaatgtctaaaaataatgccaaattagtttaatttggctttagttttcttgcaattaaacacagaatgcattctcagttcatgactcatagctgctgaagagttccttttagagaatgaatctgtaatttagtttttctattttctatgaatgcatttgactgctttatcttctttagaagctccagctcagatgtggttggatacttcaatgcacttgtgactgagacacaacacagtctaattacaaagcattctatcactcaggcacagggatataaacagatatatataatatgctttcatcatatattcttatgtgcaatttgggcaaaatcactgaacattgtctgaatttcagattcccaatttctaatggggaattttattacaattctttgactcttttattttcccactgtttgtggtctattactaggtgaaacaatttcttctggtgggattggcaatgctgaaaacttatattactatacatccacctgtgcttatggagttgaataagagatattaagtatcattcattctgggatcactagaaccagtcagatggttctgggcctgcacggtcacatcgttgcttgaattatttatatgcaattattttgcttttaaaaataagagatgcaattggtgaagctgttaaaatgactgtaattaaagtaatacaagagaaaatgatccaattttgtggatagctgtttattctgcattttacctttcaaaacaattaaattgttgttatacacttatatgctcacagggaatattggcaataaaattttaaactggggaaaattagtattttatatcagcccattagaaaaataagcaaagaacctaatcgccgtccattaggttgagacaaatgctggtctcaggagatggttattccattattttccctagtaaataagaaaacaggggggaacttccctccgttattctcaggcctgtgaggccactaggattggtagttaaagggccataatttggtaagagtttctatggcccactgagttatccaatgatgatggcttaaactatactttaaccctacacctgcctcaactgattccccactcctccttaggttagaaaattgcattgccctggaggtttgtgtatttgggtgtctgggtagacttgatccttctgccatttttcaattaaatgaaaattcacaatgaaattacattctaaatgtctttcaaaaagtacgaacaattattcattactctatttgaatagctcagtagcctttagttttcatctgaattttaatctaattgataacgaccttcagccaacttccttctctttcaaattccctaatcacattttacaaccctaccatcagactgccctgaaataggcacatccacgtggaggtgccaaggaaatctatgtaggcttgaaacacttaaaaagaactggagtggacaagaaaaagaaagatcatccaagttcttcaagtttacaaaatgtaatatctggtaatgcatctcatttaatggcccaaagtaattttcaaattattttctaaaaataacacagactttatatttccagaaaacccaagttcagcatggtattgcagtgtttaatatcatttcagaatagtcataaagccttgtttttaacatttcttcatctttaaatgagcctagcattatctccctaatgatcaataaatgtagacctgtaacagtcaagatctatgccaattaatccggaaatgttggaaaagtaacttgaagagaacattgctcctcagaaataaatcccacaatttaagagaatcagtggggttccagggctttactgccaccaagccaagtcacaaaaccaaatgtgaaaacaatgtaatcaagcatttaaatgatttatctgaatgctggatgcttggtttaataaagctgggacaacttgcctaactgcttcagtgtttcacatttcatgggtttttatggggttgtgtagacactaaccagaagaccctatgatctatttttactaaataaaaattgtgcagccgggcacagtggctcacacctgtaatctcagcactttgaaaggctgaggggccgctcacttgaggccaggagtttgagaccagcctggccaacatggtgaagccctgtctctaccaaaaatacaaaaaatagctgggcgtggtggcgggctcttataatcccatctacttgggaggctgaggcaggagaatcgcttgaaccggggaggaggaggttgcattgagctgagatcgcactactgcactccaggctgggtgacagagtgagataaataaaattttaaaaaattaggcatagtattgtacatgccttgaatttatataatgctctctattatggcattttacaagagagaagatttaaagtgtgccatctgacttgcaagtaaaaagagcatctccaaaatgatactagttactgtgaaaatatagcagcagacaacttgttcctgggaaacaaaaggatgattacaaaaatccatcaccaaaagctcgtttgaaagccttatcctgcaagaaagggctcagctgttagagttctgctccttatatcagtccttccccttaccacttccttctggtactgcctgatccaggttacaggtgtttaggccattttagagaagaatgagaatgtaccaacatgcaatgggcattttcttggagcatctgaatccattctaagagtcagtctaagactgatccaaagaaagtaagaggaaagcgtccaggcatggtggctcaggcctgtaatcccagcattttgggaggctgaggcaggtggatcacctgaggtcaggagttcgagaccagccttggccaatgtggagaaacctcgtctctgctaaaaatacaacaattggccaggtgtggtgtcacgtgcctatagtcccagctactcgggaggctgaggcaggagaatcgcttgaactcaggaggtggaggttgcagtgagccgagatcgcgccactgcactccagcctgggcgacaagagtgagattccatctcaaaaaaaaaaaaacaaacgaacaaaacaaaaaaaatgaaaaagcttcatcctaaaagaaacaaaatacacataattaggccaaatggaatgggcctaataacttcatctaaaatgaaaatctgatctcaaaagtgtacagatgggagtaaatgtgtttttaatattttatcttactttcttgcactgcatgatttcagtgtcggttctgtttctatttaattccaaaagggcttcatatttaaggatttcttcaactctgcgacaagaaaaattaagggtagttttgaagagataagctcttcggagactaaagaacattttttcaaagtttatcttctgacagcacattaatatttttattctgaagtctttgtggttttagggtagaccgaacagcattgacaacaacttagtaatgatcctagtaaccacggcacctccctcacctcttagctggtgtgtaattaacagtttaaaaattatcctgagtaggaaatagttgtccagtattattgcctctgcgcaatttgaccagctgccagctgagaaacctttgtggcaaaactttataagcttatctcttggttcatttgggttaatggcggggagaaagaaaggacagtcttcaagttgctgctaattaaaatgattgctatgactcctctctgaggactactctttcagttataaagtgcatgtgtaaatggagcaccccaggcatctgcaaattcagaaaagcaagtcacaaccactgaggctttttttttttttttttaaactaacatacaataggctcagctggaaaataaaatggtgagggaatctgtttacaagagctctttagattttcttgtatgataacctgttttgaggaacattgggaaaatattggttttttttttctttttttttaagggcaattaatggaagttggatttcacatttatgggacaaagttctcacccgccatttaaatttttcacaaagggggcttctgatgttttggggaatattagtgccatcacagctactgtcactgtcccactcatgaaccaagggcatcttactacaagcaccatgcctctctaccagaggtcagtctccagccattgctcaagttgtgcataggacaggctcattctgggaaattaggcttcctggagcagccatccataaatgacaacaggaatggatagataaataccacaagcctccttggctcttagatggaacaggtctgagatgttccctccactgtctcacagaagttcccagtgggattgtaccccagctaccctcaggtggtaaccacctattatgcaacttctactggcttccttcctttttatgtcctgtttcctcattttcctttcagtaattgttgggatcacctaccaaacaagctatgtgcactcaaatccttgattcaggatctgctttgcaagaatgcaacccaagacaagtgctattgctaagatagagctacagagatattctagcttgtacggatccagataaatcacttctcattttatttatctccttaacttccttaatcacaacccaaaaaaaggagccccagtaaaatatgcaaagcttggcaacacctaaacaatacaaaggattattacacatctgataccaaaacattaataaatgttcatgggattttggtaaacaaatcaaattttaaaagaactcacttccaagcatttcatatcacttgtgatactgtcatacagtcacagggatatctaggaatttaggttagacacctattaactggaaacatgattagttcattgaatactaaacatagcacaagtcactgtctcctctccatgacatatttcagttgaaaatggaaaatctgaatgtaaaacatttagtatattcacttcaaataatgcatattctatatttaactatttggaggaattaccactttttttttttttttttttttgagacagagtctggctctgtcgcccaggctggagtgcagtggcgcgatctcggctcactacaagctccgcctcccaggttcatgccattctcctgcctcagcctcccgagtagctggggatacaggcacccgccaccacgcccggctaattttttgtatttttagtagagacagggtttcaccgtgttagtcaggatggtctcgatctcctgagctcgtgatccacctgccttggcctcccaaagtgctgggattacaggcgtgagccaccacacctggccttttttttttttttttctgctttcaactaggtgttcgccatgccttttccaacattgggctttgtattgttattaaacaatgcctacaaggccctttcctcgaccctcctgagtcttttaaacacacatatgttctattgacattcataataaagtagaaaacagaagcttttaacagcacaaatcaagctacctctctcattccccaaatttgtcctgattatctggatactacaaggacatgtacccttttagcccaaaccattcagttgttgaggttactttgaatgtgactacacatgcaaaccagataaagaaaacaaactgaattcaataaactcacaggtcatttacaaaatattaacccagttgttaaatagttgcagctggtcagagaaaagggctgatgaaacttatgccacagactcagcctcccagtatttgaatgaattttgttccatattatagttgcagatttcacaattaatttagccaaacacaagtgcattattttcatcacccttaagaaaacccttataatcctgaagtaatttagtagatgtccctcagaagtttgtggtccacagtcgtagttttgttctcttgctttttttaacgttctccaaaaccctttgactctcattccgctacaaattggagtgtttacctcagaaagaatgactgtggctaccagggggaaagctgagagtgagtccaatttcttttggcctgtttggctttttctgggttgctttgaatgccagattttaaaagatggactaagtaccatctcacaccagttagaatggtgatcattaaaaagtcagcaaacaacagatgccgaagaggatgtggagaaacaggaacgcttttacactgttggtaggagtgtaaattagttcaaccattgtggaagacagtgtggcaattcctcaagaatctagaagcagaaataccatctgacccagcaatccaattactgggtatatacccaaaggattatagatcattctactatgaagacacatgcacacatatgtttattgtggcactattcacaaaagcagacttcgaaccaacccaaatgcccatcaatgatagactggattaagaaaatgtggcacacatacaccatggaatactatgcagccataaaaaaggatgagttcatgtcctttgcagggacatggatgaagctggaaaccatcattctcagcaaactaacacaggaacagaaaaccaaacactgcatgttctcactcataagtggtaattgaacaatgagaacacttggacacagggaggggaacatcacacactgtggcctgttagggggtggggggtaaggggagggatagcattaggagaaatacctaatgtagacgatgggttgatgggtgcagcaaaccaccatggcacatgtatacctatgtaacaaacctgcacgttctgcacatgtatcccagaacttaaagtataataaaaaataataaaaaacgatggactaagaaaagaaaaatgagaaagaaaataacaaattttgcccttcttttctcctgaaagcatatgaccattgctggacttctgaaatctaaatcagatcatcactgcagctaataggtaagtaagtataaacaagtgcctcaagccttggtataaaccatgtatttcatattcttcatttatggtgactaaaattgaattcaaattgcattttgtggtattttgacttctcctaaggcatgtgcttctaggaaatgagggaatccaggctctttctatgaccgctgctgatactgtcacactgtgtacctatccttttcctctgattctcctcagcacctgctcctatctttctagaaaattaggattctacgaattagatggaatgaatgcattatataccagcaagaatccaaatagaaagatattttggaaagagacatgtaataagagtatgcccatttggaatactaaatattttattgatgtaacagagaaaagactaatgaaatttgcatattaggcaaagctgagagagatcccagatattttagaagtcagaattgaaacaaaatgaagtcctgatcaatcagataagccattctgacttcaaagaagacaatgataaaatactgaataataaataatacaaagactcctctatgtaaagggattttaaaaattcagatagaataaaaaataaatgtgcaaaaaattctataatgttattcaacttgaatgtgttaaaacacattaaagtgaaactttgtgcatattattattgaagtaaggttgtttacatagttggaaaatcattaactttaaagtcagaagagggattcaaattttggctcctccattttctagctgcatacctgtagattaattatatatcttattttagacttttctttaggtatgaaactgaggtaataacatttgtttcacaggatgctgtaagggttaaatgagctaatgtaagtcagtggttctcaaaggggtgatttttttcccctaggggacatttagcaatgtctgaagacatttttttgttgttgttgcaatggggtggggttgtggtgtaagtactactggtatctagtgagtagaggccagggatgctgtaatattatactaagcattctacaatgcataggacagccccttatcaaggttgggagaacccttgtgaagtgcatagccattacctggtatgtagtaaacaagagccatctataggtattagtttaattattgaacttgaataagaatatatagaatcaacttaatttttctcagaagagacaagagaagaaagttgtaatattaagttgagccaaacatgctgacagtgatcctgggtataaccactgaaggcctttgtgggacaaactaaaatgcccatttcaaactttttaaacactaaaaacaaaaggtaaaatttgagccattaaaaagtgttgagaccattaaagagttgtttttgctggggtgatgcgaggcctatggaaaattttaaattacacaaacaaataagactggatttaacacatttcaaggtattaaagctattaagatcactagactgtgaaatatgctaccaaggaagtgccagatctaccaccaattgagacacttaaaactcaactaaaacattacaaagtatatttctgggaaaagggaactagcaaagaaggggatcaaactgctaattcaagagtttttttttctttctgatatttgtatttcagcagctatttttaaaatggtaggaggcaaaatgtcaaattggaaacaagtttcatgagatgacccataaaattacttacttgatcactttggcaaagaccatggaaattgacaacagcttactattgtaaaaaaattaaagctgttaaagagtttcctcttcgatattataatcaaattagctttagtatctacaaagtagacaatggagttgactttgagccaaaacaaaatttttttcagacattaacgaaaccacctggaaatggttacataaaagataatgataaagttcactgtaatgatttttaaattgattgcctatcccattttagttgcagtttctttacctcatgaatggcataactattcacaaatcttttaaaatatttaaggattaatgtttgagaagtactttgtacactgacagcatatatatactagcatactatgcttcatcctctttaataagaaagccatttgacaagaaccatctcaaccgattaaaacaaaacaaaatcacaaattcacgaggtaagcaaaatacagaaaatgcagacaagtcaggctatgtgacttgctgaaggccagttggtatatttataaggtaggggtagcgtgacaaaattagatttccctgacaactggtctagtaccctttctgctgttttgactgccttccttccactccttcaagtgagtgctaataaatgaaagagaacatgcttaagtcttatattatccaggcatctaaatgtttatttccctaaattttcagctcccggttcatggttgagtccctacatgtagcagttggacatttgataaatatgctaaattaataaataaaaattgagattttgctagcttcaacagatagactactagagtttagatgagatggatatattttcttaagaatatccattagtcaagacaatctctgttcttggttaagtctttttgaattagcaactatgaattgtcaagtcttgtctaaattaagatgtgtaatatacgaaagtgctctgaagtagaagaaatgtataatgatttgttctattttcatcaccattagctgaaagctggaatatgttaattaaaagaaaatatttctgaacactcaatggagttcacaaggggaacaccttagtaattttccactactggaaaagttgtcatgtaaagaggcattgggtttacgctatatgatccaagagggcagaactaaaaccaaatgattttggttttggactagcaaagactatccccacgtgggaatggcttcctctggaagaaatgattatctcatttttggaagtgttcaaatggggatgggggccatcattcactgggaaaactgtgagagggattcagacattgagtagaagctgggtttaacacactcacaaattccatctttgagtttctattatcatgatggatagagagatataaattagtgaaattgctacctagctctctacctcaaaaactagtactacctaaaaaaaagttgtacttaaaagaaaatttcaacagactttattagcaatgggggtcccactttattaaacagtgcagtcaaaatgcactcatgtttagccagacttttcctatttgggcacaatgtttctaattgaaagtaagatagatgggatactgaaatctaagcagcgccagtaatggcttctaattattttgttgtaaaaacataggcattttttctcttttaatggctgtgttttcctgctgtttccaattgcaacagcttctttaagaaactgtgtgaaatacttcctaggtaatcatttggctagccccaaatgaccaatttatgacagctacgctaaataatattaccggaattcagtggtactgcccagtcacagaagtgagtgtaaaatacactgcaatttaactctccccacaggatcatggctgtaatctcactgttggagaaactgcttacttcccaaatgtgtttgcaaaacaccaactgaccaaaagagtgataaattcaattagtcaaattaagatgtactcacaaagtacaaggctctgggatgggctagaaatgattatttttccaaaaaggcatttttttaaacaatagtatgcataagcatagtcagtggattcattaaaatgcccagtcatcggttccactccgaattttcggattcagcaatgctgggtaaggcacagaaatgtatatttttaacaagcaatgcaggggagaccaaaggaagtggcacatggactatattttgagaaacactggcaatccttctatatactatgctttagtttttcccagattatgagttataaacatagttgctttccatgtataaatgtttttattcagaattatgctactcaggaaacttaaatataatttgataacccttcctttggaactgatcattattcttatatccattttttggaggagaaaactgagacacagagaattaatttcaattctcaacctttccaaaataacactgaattacctccggttagcaagtaagcttggcttttgtactgctgagaccctagagaagcccggtccaacagaactttctgtgatgatggatatggcctgtgacatcaaagatagctaatagctaataactctgtgtggttattgagaatgtgcaatggggccagtgtgacagaagaattacttttctaattttagttgattaaaatttaaatttatataggcacacggggctagtggctactgtttggggtatcatagctctagacaggacttttgggagacgtaatttttgggggcaagctcttagaactgtttcctgaaacagggtgaacaatgggaagaatgaggaagacattaggaagatgttggaagttaatgtagtgcacctggaaaagtttttgttgttgttgttctttgcccaccagacaacaggccacatgcccagtattttgctggactaagctaccacgcttccaacaaccttatgtaataaaacagatgcctttaccttctgactaaattcagtctgttgacctgtgattctctctctctctttcttttttatagatgctggccttttttgcagtgagttacctctaatatacacttactgaaagcacacatcttcacagctgaaaataaaaataaaatatattccattacaattttggtgacatctctcctagcagatcttgtaagctgtatttcccaagcaataccgcttttgatcactttctcaattcctcacatgaaatattcattgtagtgaaatgtcttagtaaggcaggtttaagagagaagagggaaaacaaatactgaaccatgttccaagaatatggtaaaaacaaaagaagcaaaagaaagatggaaaaatatgagattttaattaaactacaaaaatgttactgatttttatcccattcatttttcttgaaagactttagtctttattctctccttctttcccataccatgtacaatcacaccatggcaggttcttaaagtttaactgttagcaactctggctgcatattagaatcacctgggaacatttaaaaactactgacatccacattccactcttggagactctagtttatttggtttgaggaggagccctggaatagcatgctttaagatttttgtattttagacatcacaggattttagaagaggaggggaattagaaatcaatgaatcaactcctcttattttgcagatgaggtaaatgtggtccagagaagggcagcgactggtccaggctcatgtagttagttatttgttcctgagctaaggccagagttaaagatctgattcctaagtctaattcttctagaacagtacactgcagcctacctttatctagacatgtttcctattggtcctactcttccttatacaataccacttttgctttccctgtggtgtctatttcaaaattttcttgggttgtatgatgcatttgtactgattaaccacttgaggagattgttatatttacctttgggtagactgtctctacctagaatatctcaaataaggtggtatatattaggtcagagcagtagttctcaatcttggctgcgcattagaatcatacgagggattaaaaaaatactgatgtctgggtctcctctcaaacctagtaaaatcagcatctctatagatgggcccttggcattggtattttataagtttcccgggggattctaatgtgcagccaaggttgagaacatctggaccagaggaagatataaagaaagacttttaattattaagtacgggatggtcagaggacataaatggttatgctgacaatatacccccttgtctaatataatttaatttaatataaatttgccatgttggctttaccaagacctcacaatttgggtagttgccatggttaccacaaatgcaagttcatggttgggaatacagaaaatcagtatttccttcacagtaacatgtgagctatgctgagctcaaagacccagtgactttttcagtagctttgagaggcctgttttatgtttgctttcatttcagaggtactgttcagactcaagggccaaacctaggaaattatttttaatttttcttttgaaaagttttctttaaaagaaaaatactttaataagaccttgacgatagtactttatgtaaaatgagctggttcaagatggagcacaacaaccaagaggcatactctaaagaaagagaggtggggaagggagaaaaaaagaaagggaaggagaagaaagaaaatgagaaggaaagatgagtaatgagaggaagggaaagagaaaaaaacagattcgatactctgaactcttacaatttgcaagcattatctcattcaatgctaaaacaaccctcgagctaggtgctattatatttgtcattatttagttggaaagactaatcctcagaggaatccacttgttcaaagttgccagattcataagaagatatttgaatcttggtcagggtttctagctggctctgtgactttaataacttcagtatcctccctttccgacttagttgttgtcttctcaatcagagtgggaattattactaactggacttctccatttgtattacacgtgtcatgcacagaaaaatgcaagaggtatgtgttagctgtcattggttctagttcttcactgttcccttcctgtatccatgccctttgacatgtgactttgcaactcttccctctatagagttgtgtattagtccattctcacactgctatgaagaatacctgagactgggtaatttataaaggaagaaggtttaattgactcacagttccgcatggctggggaggcctcaggaaacttacaatcatggcagaaggcaaagcaggcactttcttcacaaggcggcagaaggaggtgagtgcaagcaggggaaatgccagacgtttttaaactattagatctcatgagactctcactttcatgagaacagcatgggggaaacctcccccatgatttaattatctccacctggtctctcccttgacacgtgggaattatggggattacaattcaagatgagatttgggtggggacacaaagcctaacaatatcaagttgtattgtatttcctcaactcttgagtttgaatttggccatatgatttgttttggccaacagaatgagatgaaaatgatggtgtgccagttcccagtctaggcaaaagtcttttgtgcctccaccacgccataaagaggtcagaccctcagtgatccaaggaagagaatgagaagtatttggagccaactcacagacctgtagtgtgaagcagagctacccccagccacatctttgatcaaagtccagctgacctgttgaccaatctcagacacgtgagattgcccagctgagttcagtaagccacccagtccaaccacagatgtgtgatttgtgagcaagcccagctggagtcagtagaactgcagatgtataagcgaatcaaatactatatctatctatctatctatctatctatctatctatctatctatctctctctctctctctctctctctctctctctctctctctctctctctccccctgagattttgtgattcttatgtctagtagctcatattacaggataagagagagctaatatcactgtacttttgaatatgtggacacataaaagcacgcaagggcagtctacgtgtgctacagtcaaatacctgtacaacatgactgctgggaggaaaaaacaccctgttgtttatctctcctggtcacacaatgtcaagtaatcctgagccacagggatatttctttcctccatggtaactgatctgtagcacactacttgttaaaaaggacatcgagtcagagggagaagacaaagaactttacagtcataaggttgatctgtggctccaggaatgttattctgaaatatcctatagcctgaaggtgcataaatagccagtgggtcctcccttctttataaagatatcacatattgctgatctttgcttctactgagcactattcttaacagctattcataacctttagggactagacactaagaacagtggtgactctcaaggttaggtaagtaggaaaggaagatgaggttggaaagagtaataaagggagacagtttttataatacacatgcctatcttgccagaattgctggtgggaagtcatatgcatattttataaaatcacccaacatactctggtacttatgaggttccagttgagaaagacttcactaagagcagtcttttcaactttttcagtctatggcccatctttcctatgaaatcccactttccacaatgaaaaagaattctatgattaccaagaattatagagaagcaaaataaataacttgtagtaaaaattttttgttggcaatgtatatgaatctcattattaactttcagaaatatgagtctttaaacaagattctgagagtccttgtacatttttgaagtttaggaatccaacttcccaagaaatgaaggaacaatgaattcatatttgaacttcaatgcatatacatcttaacttctagttattggaaaattatacataaaaatattgttgatgcaaaaatgtatccctactcactgtaaggtgaacaaacaactattcccaagccaaattaataatgatgaagctaaattggcagcatttataattaaaattcaaggattacagcaattaaaaaccacaatcaaatgaagacagcactgatgataaactcactgattacaaattgccctttctggaatttggtggaattccaactgcatatatacttagaatcacatgtggcagccccatttctagagtgcaaatgaaaatctttagtagactctagcaatctactagaaagaacaaagctgcgtcttgattattttgttatgagaatgcaaggatgctttcaaaagttctggagtagtatcaaagggaaccaacctaaaggggctcccagtggtcaaattgtggcactggataatgaaaagaaaataacaattgtagtcaatactatttctgagcatgagatctatgatcaatagagaaatattaataggtatgatcataagattttctgctgcaatgcaatggccatctgtgtggaaaatgttcataaattagatgatattttgtacactattacaaatattaatggactgcaacaaggcattcaattcatggctgcaaaaatagatgttactgggctacagcctagagactggatatattaatatttcaaaattcagcagaaaggacatcacttcaattgcactggatgggaccatccagtggtccttctaaccactcaccaaatgacaaggtctcatgctttccagccctgaatcttctttccccctgtaagatgtctgctgcactcactaagagctccttactcgtagtttcatgtatcaccttatagccataaaaataaattgtatgtattttctactagcccaaaatttgctctttagaatgctcaccttgtagataaaaattaagattataatcatagacttttccttgccttttgagaacaaccgaccctcaggaaaaccatgcttccttgaattcccccacaaaatcaccaaaaagcccatatcctataagaagactcttctcacaccctcttcctgagctgcctcacggtttcctatcatgtactgtcttcctcattaccttgggccaataaacccaattttttcaaccataactatgtctctgatggtcttcggctagaaggcactgacgtcgcaaataagatttgacctggaccacttcaagaacaaaatcaagagttaactttaaagtatacactacaagtaagtgtcttctgctgagaaggagagagaggaaagagaggagagagagagagaggaaagagaggacagagagagagaggaaagagaggacagagagagagaggaaagagaggacagagagagaaaggaaagagaggacagagagagagaggaaagagaggacagagagagagaggaaagaggagagagggagaggaaagaggagagagagagagaggaaagagaggaaagagagagaggaaagaggacagagagagaggaaagggaggagagagagagaggagagaggagagggaataataaccactaaagtaattaaacctaaaaaaaaatcaccataagttactatgttgatctccctggatttgctaatataattactacctttcaattctaaggtacaagattttgtcattccggattggaggtaaatgtcaaagaatgattaactaagatcaaaatgatatacctttttctactcagtattcattatacaaatgattttaaatactgggtgtgtgcccttaatattcagggctctaaaaaagaaggtactttaattgaaaaaaattatgcatacatttcaaatagtgcagaaagtatgcatggtttaattatctgcaggttcactgcagaatcaaattcaaagcaagagggtatttaaaagccaagaggtgtgtgtgtgtgtggggggggagggcatgtggaaatgccccttttaagaaaaatatgaaaatagaaatgtctctctttaataaaataagtagttttaattagagaagaaaataaagctaatcactttgacttaaaatacagagcctcaattattcagatggggtctgcaagtaacttcgactgtgatgttaagaatggtgaatttataatctggtaaactaagaagttgctctgaaaaggtaactaatcaggatgaagcaaatgtctgaatattacgctgtactctgctatctgctttaattcacaaacttctctgttgagcttttcttcttttatttgtaaagagattctcttgctgtcaaaccgttttgcaatgagaacctgtcttacccatctgaacttcaaacacgcatcattctgtaggtatcatggttggtgagaaaaagttttaaataatttaggaattgtcataaaatatggttaatgtgggaaacagcgatagttaatgtcattaattactttttaaaaacattggctgtattaaaacctaagacaaacttattgcttatattttaggatttttttctgccccaacctgaattcttcattccagtaactctctaaaaaggtaactgtcttccacagtgtagacatatgacaaaacatcacaccgtgccccataaatatgtaatacagttgtcccttggtatctgtgggaagttggtcccaggacagcccccttaccaccaacctgccctagtggatgtcaaaatctgaagattcccaagtcccttatataaaatggtgtaatatttgtatataacctacacatatcctcccgtatactttaaagcatctctagattgcttattatacctaatacaatgtaaattgcatgtaaatagttgaatagttgttatgctgtgttggtttttaaatttgtatttttaaattgttgtattgttattacttatttatttatttgagacggagtcttgctctgttaccctgtctggagtgcagtggcacaatctcgcttcactgcaacctctgcctcccaggttcaagcgatgctcctgcctcagcctcccaagtagctgggatgacaagcatgcaccaccatacccagctaattttttgtatttttagcagagatggggttccaccatgttggccaggatagtctggaattcctgactccaggtaatccacccgccttggcctcccaaagtgctgggattacaggcataagccacaacacccggcctgtattgttatttttattgttttctttttccaaatattttttaaccatgattggttgaatccacagatgcagagggccgactgtatatacagtaaaaaaaaaaaaaaaaaaaaaaaggttagtgtgacttgcattgtctgaaacagctcctacatctatagtttcttacccctgaagctgtttgaaaaatgaaaaagtgattctaacacatcccaaacctgaagtccaacatgaggctttgcttactgttctcgattccttcacaaaggaatcaaagagatcatgacacatgacacagtgttgtgtatacatagaagacactacaaagagaagcaaatcagccatcctgccaaaccagaaatttagtgtctggattatgagaattttctctgggaggtattagatagacttgaagagccacaaagaattaaaatctgtatgtttggaaagaaaattaacttcaattatttggtcttctgaaaccattatagttatgaacttcattagttccatgcagaaagtttctttacaggaaagtttggtgtgtatatgtggagggaagggtttgggaaggggttctgcttattttctgtatttatttttatgacaagaataagctctttgtgctgatttcaactctctctaaaaacaaagcggaaacaagcaccataacagagaaaaagaatgagtgagcgagacagagagagagataggaaatacatttgctccaggctttctacctaggaagattattgattcttgcttttatatatgtaaaaacatgtataattgacttgaaaacgctaaagttaatatttctacctaactgtcattctctggtatataatccctgttattatctcttattttcattctgttaacatttctggaaatagtgtacatattgaaaagagcacaggtaggtgtaatgaattttctctaagtaaacacactcatgtaactaactagatacaaaattggcagtacccccataaagtctgcatgctcccttctattcactaacctcagttccccaaaggtaagcactctcccagtttctaacaccagagattaatttgcctgttcctgagtttactgtaaatgaaatcttattgtgtgtactcattgggtctgccttccttttctcaatattgcctttgtgagattcaaataaaacacatgatattgtgtgtggccctaattttttcattttcattcccttgaatgaatttacttcaacttatttaactgttctagtattaatggatctttggattgctcccaggattttcattttgtcttgctttttcttactattgtgaacaatcatgtaatgaacattgtacatattttgtgcatcacgaatgtaggcattttgttgggtttgttgctaggaatggaattgatggggcatgcgatatgcagatgttcagctttagtagatactgccaagcagttctccaaggaacaaagtgtatcaatttacactcccaacaacagtgtgtgaggcttccagttactccacgttctcaccggcatttggtattattaattgtttcaattctacttattctggatagtctgaattcattgtgattttactttgcatttccctgaggtctaatgaaattaagcatctttatatatgcttataggctatttggctattcttgttagttaagtgcctgttcaagactttcgcgttttttttcctgagttgtctcccttgttctcattgatttgcaggagatctttctgaattttatgaacaagccctttgacacttatatgtattccaaatatcttctaacaatcggtggcttgcctttttactctcttaatggttcttgtgatgaaattactaccttaaaaaatatagcctggtgtggtggcacacacctgtagtcccaggtactcgggaagctgaagtgggggaatcacttaaacccaggagttccagtccagcctggacaacatagcgagaccccatctctaaaaaaatgactatcacttttttctttctggtgtttttgtgtcttgtttaagaaatcattacagtatcatgtctattacaatatcatgaagctattctattctttttctggatgatttatttagcttttcatcattagatctacaatcctcctggaattgatattggtgtgtggtataaggtgattaagatgattttttttccatttattaaaaggaccagactttttctcatactgttatattacaacctttattgtaaatcaaatgtccatatatttgtcagtcgatttctaactctattattttctattggtctatttgtctatccttgcagagataccacactgtcttaatgtagtcttacagtaagtctgattactagtggtgacaagcttctagctttgtttctctcatacaagattgtcttgacttttattgggtctttaatttttttctgcatctattgtgataatcgtgactttttcttctcctttattctgctacattagtgaatgaattgactgatttctctaacgttagccaaccttgcactcatacaagaaactctacttggttatgatattcattttatatatcacataatctgatatgtcaatatcttacttaagatttacatatattatatatatatttacgacagaaaatttgcgtaacttttctttcttgaaagttcttcgtcagactttggtaacaaggttatgctggtctcataaaactagttgagaaatatctttttgtccttattctctggaagacatgtttttacattgattccttaaatctttgaacagatcactttggcctggaattttctctttgggaaggttttaaattgcaattcaattcttagcatgtatttatatagattttctactcattgccaaaaagttgttcaaaataccctctcgttatctgaaatttctgtagccatgtccccttatatatttgttatatttattatttcacacttttttcttcattcactttgccaggggtttaactatgtcatttgttttttcaaagagccaccttatgcattttttcttcattactgaacaattactttcatttcagtactttctgctttttgttatttacttcctttgaatttaatctgatgtttacttttactaatacctggagaagaatacttatattgtcgatcggcagagttttgcttcttttctaataacgtctttatgggctatacattttactctatgtatggctttagttttatatgtagtattttcattatctttcagttcaaaccattttctaaatatccattgtaattccttcaatgatccacgtgttatttaaaattatattgcttaatttccaaacacatgggcccttttttggttatactttctgttacagatttctagcttaattatgttaggttcagaaaatatactctgtgccatttcagcctcttgagatttgttgagacttactttctgcccaagtatatggttagtgttgcacatgaaaagaatgtgtattctgtaattgttgagtgctaaattctctatgtatcaattaagtcaagttgtgaatcatgtgttctaactttccatgttacccgattttcttttggtttatcagttactaacagagatgtgtttaaattctctgccgtgattgtagatttgtttattgttcctagtgtttatctcagtgcttttaaaaaaatatgttagatgctcacaaatatgaaattgtttaatcctcatggtaaactaaatgttttaccactatgaattgttcttccttttctctagttattttagtaaaattatttcacctttcttttggttagtgtttgaaatgttccctctcactcttttatgttcaacctatctgtatctttgaatttaaactctcttgtaagtagcttagtcattgttttcttttagttgaagtttttcgtacataatggaagtatttggtacatataacttaatgtgattacagatatatttagtatcaaatctactattttattctatctgtcattgttgtatgtcccctttgctcttctctcatgcggtacatataacttaatgtgattacagatatatttagtatcaaatctactattttattctacctgtcattgttgtatgtcccctttgctcttctctcatgcttcctgtgggttttttttaatatttcatttttttaccttctgttaatttattagtatgctgtcttttagtatcacttcacaatttactccaggaattataacctgcattcgtaacttttcaaactctaaaataaattagtaattttatagtttcctgaataatggaaggaccttataaaactttaactccttttactcctctcctgcttttatgctgttcttttttgaattttaaatctgtttatattcaaaacagtctaagacataactgttgtgttatgcagtcagatttatttaggtttacccatatatttactctttccactgtttttcgttccttattgcatctgtatccttctctgtgggatttatttaccttctcttttgtagtctctatagtgtatatctgcatttagttttactgtgaagaataccttgattagatattgatttctaggttggcaattatttttctttggcactttgaggaaatattttgttacacagttaactatcagtcttattttgctctttgaaggaagcacatctaatttccttctagggttacttcagatttaagattttctttttgagtttcatttttagcagttttatgatatgctcagatgttgttttatttctaaataataatatggttatctttgcatataacttgcttggagtttgtaatgcttgttttgaatgtgacttcatagctttaatcaattttggaaaattctgtgcctttgtgtctttaagcatggcgctttccatatttgactctttcctctcctgggattccagttgaattcatgcaccaccttttcactattacattattatgctatttttgtattttccatcctttgtctctttgtgatccagtctggatatttactcttgccctgtattacatacagttaacaaattctctcttcagttgtgtctaatctcctaataagcctaaccagcaagtttttatttcagttattgtatttttaaattttagaatcttaattaagacctactagttgtctgttcatattttattttcatttaatcttttgaatatagttatcaaagtaatgacacagtttgtgttaagtaacttagctaggtctcagattagtctgtttttattgttcttgttttcccttgaattttggtgaattctggtcttttgcaggctagttggctttgattaaatacgaggtattgtatacaaataattgtagatataatttgacatttgggatgatgttattgtccctcaaaaaggatatgctttttctccccccggcatgtaagttaggcaggaacagatcacattaatgcaattaggagttgagctgattcaaggctgaatttgtacagctgcgagagctcctctaattttcattttattctcaatcctagggtataccctttgagaacctcaactaaattcttgcgtatttaccagggcatctttaccttggcgggcttcgaactcgttttttccctccccgtcttcatgagataacaggagttatgcatagcttcttagtctgtccaagtttagaattggaaaacacctcaagaagaaaagcggcaccaatgataagacttctcttctctgtgggcttcctttctctctgggttattgattcctcacttctttctgccttggcagttctctaatacctttaaacagatcttaaaacatttttatacactgttttttttcctagttttgcttgtttgtactattggacttacaggctagctagcctgccattttgttttaaccatgtctcaaattaatcattattaatttttttcagtaaatgcttattataattacctatgtgtgtgtccatatctttgcacaccactgccctttaaaacattttgagatatattataccttaaaagaatgcataaaatgtatcttgtaggtattttcacacgtttgtacatatgcatgcatacatttgttcaccatatgacaaatcaccatattgtacacttatggtttgaatacttttctgtatatgttgtatttcaattaaatattttagattaaaaatctatataatttaaagagtaagaataaatagcgttgtacttattactaaagttaaaataatttatagtatcttaaatgcttccagtgtgcctctcaccaattgtatttccctctcctgtcacttccaacaggggtaacaggtatcctaaacttgaggcttatgaggattttctatttttttatatacacatagctaaaatatacattattttgcttccctggtattgaaccttatataaatgggattatacaatattttattcttctgtgacttgcttcctttgctcccattatgtttctgagatttagagatgctgatgtgtggcagtaattcattgccccgtgttatcccaatgcatgaatacatcatcatatattcacccattctacttctgtgcacatttgttttcccacaggtttttgctattgtgtacaacgtagctataaacatatttgtatgtatcacctggttatatgtacaaaattttttctaggacatataaccaaatatagaatagctgagtcacgggatatgtgcacataatgcggaaaattggtttctagaatatttacatcaacttaaatttccactaaaagtaaatgagagcttctgttggccctatttttcttcccattcatttatcaattactgatagagaagtgtttagataaactgctatactggtagatttatcaatttatcttgaagcttggtcatttttgctgcggttatttggagatggcattcttaggtatgtacaagtttcaaattgttaaattttctagcgaattgatctttctgtcattaccaaaagacttactgttctcccaccccaccttttgtgaatacaatgaaatcagctttcttttacttagtatttgccttagtatttgcctctttcccttaccatgtccttatgttttagatgtgtctattgtcaacagtatagagcagagttttataaatgtatgtgttttaaatccaactggcagtgtttgtttcttaattgaaacatttaacaatatttataagtactgacatatttatatttatttatataggtaaattaagtaaattatttactttgttctacttttttgtttcttttttatttcataccttcttgtaccgtttttctcattccattgtccctaccttttggagacaataagctaaattttttgtttgtttgttttacttattatcccaattattttaacattatttttcttttctttttcttgagacagagtctcactctgtcacccaggctggagtgcagtggtgcaatgtcggctcactgcaacctccgcctcccgggtccaagcgattctcctgcctcagcctcctgagcagctgggattacaggtacccaccaccatgcccggttaatttttttttgtatttttagtagagacggggtttcaccatgttggtcgggctggtctcgaactcctaacctcgtgatccgtccaccttggcctcccaaagtggtgggattgcaggcgtaagccactgcgcccggccttaacattctttcttaagaaaatatagaagcaatcaaaatttatccttttgaaacaagacaaggaccttagaaaactctaatgtgattatctttcctaaggtatgttatttctgtcaagtgttctgattttacctatttccccacacaagcacaaattggatgttatagttataccatctccaatcttggaccttgaatatgggaccatttccatttgtctaaaatatatggtttgaattttattttagatagggtctttttgaagtaaactctctcagtcctgtttgaaaatgttttcatttggttgtttctcccaaaatacatgtttgtttggtatagttgttttttcacttagcagattgacaatattattccagtgtcttctagcttacattgttgctactcaggtggtagctatctgtctaattactctggctttgtaggttatctgtctttcctgtctggttgattttaagattttcccccttttacggtgttctacagcttcactatgatgtgtctcgatatatgtttaattttacatattctgtagagcttcactgggctttccagattagagaactggtgttctcttgttaaccacattttgaacgttttcagccattgtgtttttgaatattgccttttctactttctactatctccttctggattaccagttagatctcttattcaaactttcactctttcatgtattttaacctgtcacattttccaactttgatcattttaggccacattttgtgccatttgcttagatccatatatcatttatgttttattgatatataatagttgtatatattttgggggtacatgtgatattttgatagctgtatacactgtctaatgatcacatcagggtgactgggatatgcaccacctcaaatatttgtcttttgtgttgggaacataaaccttctagctattttgaaatatacaacaaattagttcttttatctagctgtatttttgcaccccttaacttctcttcatccttttctccccctttcccttcacagcctttggcaactaccattctattctttacctccatgagattcactgttttagcacccatatatgagtgagaacatgtgctatccatgtgatatttgtctttctgtgactggtttatttcacttaaattaatgtcctcctgttccatccatgttgctgcaaacgtcaggacttcatttttgtggctgaataatattccattatgtatacacacattttctttatccactcatctgtagatgggggcatttaggttgatttcacatcttagctattgtgtagtgttgcaataaacatgggagtacagatatctcctcgatatactgatttcctttcttttcatatatacccagcagtgagattgctggatcatatggtagttctatttttagttttttttgacaaaactccatgctgtcttccacaatggctatacttaggtctatgtttttattcaatatcttttattttcatttagttcatatctgttgttgatacaaaattcacttcaatttttaattattttacttaaaatgttctatttgaatcttggccaaatttgcttaacaacaacaacaaaaaaaaacaacaaaaaaaacaaggtcttgctctgttatccaggctggagtgcagtggcttgatcatagctcactgcagcctcgacctcccagattcaagcaatcctcccacctcagcctcccaagtatctgggaccacaggtgcatgccaccacgccaggcttattttaaaaatttttagtagaggtggggtctcaccatgttgcccaggctggtctcaaactccaagttcaagtgatcctccaggcttggcctcccaaagtgctgggattagaggcatgagccactgtgcctgactgcttaattttttttttttttagtttgtatattgctcatatttctgagcttttttctttaataagattaaatattgctcttttatattctgtattgataatttcgatatctgaaagttttttagatctgtttctattgcttgtgttttgttggttctcatccattatgccttgtttcctcatggattttgtaatttattttaactgtgagttcctcttttttctttgaaactttatgggaattctttgtagtaggttgaaataggccttttccaaagtagattaaatatacacaaggtacataaacagatgtataattgctaagacatatgataatctcctgtagttcactagctattgccatattatcctccaaagtgtttataccaacttacgctttcccccataagtatatgaaagtttctattctccacatttcagatgcccggtattatttgattatcctttataactgctcatctggtaattagggagttatatctcatttctgttttatttgcaattccatgatggtcagtgaggctaagtatcttttcacatattaaacggtcatacagattttctcacttgtgaattttctctccaatcctctaccaggtttataacttattctgtaatgatgttaggaattttaaaaagatattcttgaaaatatttatttattggtcatatgtactgcaaatatctcctgggtttaaattttattacttcttttgtcattttacaaattttaattttaacatggattttatccacttttttaatttataggatatgtaatataggattttgtatcttaagtagttcttcattatcatgtcataatgttttgcctttcttatttaggacttgaatccaactggaaaacattttatgatgggagctatagtgacttgattttattttcatgaagatatgaaagcatactctatataagcatttctttgaaagtcatctacgtaaaacattaacctctctcgctcgctctgtgtgtgtgtgtgtgtgtgtgtgtaggccttttattctattccattaacgtttgtctagcactttgtcactatcatcgagttttgattaatagatgtttatgtaatcagccttgacacatggcaagggagaaaggaatctgatcttattcttactcttttatttttccaaattgttttttctaggtcctttccttttccatatgaatttcagctaacttgccaaattctcaggactttgttaaaattacactgaatttatagattactctgaggcaaaaaaacaaaatctattcaatattgaattttaccaccataaaacatggtatgggtttccattcaatcatatcatcctttatattgttgaattacattttaaagactctagaaacattattatacaaaatttggtggagctatttcttgtctttttaaaaatgtaattgttatcttggatgaaatatttattgatattttctattttaatgaactatggcgatgccatagatttttgtggctaatcttatatacagaagccttgctgttggtgttaagagttttagaaatgtcttaaattttcatgtagccaatcatattatttatgataaacaattctgcctttttattttcagagtttatccctcttacttctagagcaattgaattggctaagatcttcattacaatgataagtgttaaggatcatagtaaaaatagttatgacaactctaaaattttaatgttagctataatatttactataagagttaaagtttacaacaaaggattttgaatattattgaattatttttccctacttttattgggatgattcttttctactttaattttttattaaaagattatatttcattatattcaagattttaaaacctgaactattcttgaatttggggaatacacactcctttacttgttcattatacattttaatacatagctgaattatattttgtaataaattatctgtatttttgcatctatgttcagttatatttgcttataatatccttaaattgtactgaaattttctgttttaatatatttctggtttaatatattttattatattttataaaaataattgaatatatttaccttttatatttttgcaagtgcttgtataagatgaatatcttttcctgtgaaactgcaactgataccttgcatggggatgaggaatagttttgatttcttatttaatttttaaaaaattgttgatttgattaggttttgtcttcattaaccaattttgtaacatgctttttaagaaaattattttgttctaagtttaaaaatgtattggcataaaattgtttatgattctcttatttttaaaatccccactctaactatagttgcatccccctataagaatctgtacaaattctttcttactttttaaaaatttcagtctttttttttttattgaatgagcctgctatgggcttgtccatttcattcagtttttaaaagtaccaagtctgggttatattatttctctttttatccctattgtattttaaatatatattttgcttttgttgtcatcatttccttcctatttcttcctttaagtttgctacatatttttctcttaagtttgaattcttattttttttttctggtacctaataatagcacagtattagctttattgtattaactaatatcatcatcatcatcatcactatttttttttccgtatcatgccaactgaattcttatttttaaaaacctaaacaatcagccataaaaaagaatgagttcctgtcctttgcagggacgtggatgaagctggaaaccatcattctcagcaaactaacacaggaacagaaaaccaaacaccgcgtgttctcactcataagtgggagctgaacaacgagagcacatggacacagggaggggaacatcatacaccggggcctgtcggggggtgggggacaagaggagggagagcattaggacaaatacctaatgcacgcagggcttaaaacctagatgatggcttgataggtgcaggaaaccaccatggcacatgtatacctatgtaacaaacctgcacgttctgcacatgtatcccagaacctaaagtataataaaaaaaaaataagcacatatttatagcacataaagctataaatttacctctgagtattgctttgtttgcctttcacaagtgttactatggaggattttcactgtctttttgtatacttacagttttttaaaaattcggactcactcttaattcacgtattacttagaagtgcctatttcagtttccaaatttgtatgtcttttgtgtgactaccattttcttgttagtttaaatttaagtgacttgtagttagagaattttgtttgtcttatataatttgggggaggatttcttaagatttattttgtcttcagatgtttaatgtgttttagaaacaatttatagccctttatagtggatgcagggttatatatacacatatatacacacacacatatatacataactacacacatatatatatatacataagtacacatatatacatgatgtatatatgtacacacacatatacatcgatgtatatatgtacacacacatatacatcgatgtatatatctacacacatacatatctacatcgatgtatatatgtacacatatacatatatacatatatattagattgagcttgaaatttttaaatatgctatacgtttattcattttgtttttcatctgttcatttctaatagttatgttaaatattctgatatgattgtagatttattttgcttcacattctattcagaatttctgtgtgtttttagttgaggggtggatattagcttaatgccatgttgccaaatctgaacaagatcatttatcctttcagaagatacagaaatgaagatctcaataatccttagaaatcacacattctgttaggtaaaaagagagaggttaacacttggtcctagactctagttgttacagttggaaaggatcttatagattcttcaatttccagttatcttctaatttctctatgttaaagtactgctcccctcaaatgaataatagattcaaaccttggctctttgacttatttttatgcaagatattgagacaaagagatattttccttaggaactacaaaattactatttttattaattgtaaaataccataaagacattttcaaataatagtccgtttttaatccattagaaaaaactaaaggggaaggagaataaagcaagtttatttcagagatttagttaagagagggagagaggcacagagatagcacaagacagacacagagagacagagggaatgtgctcacctaatagtcccagggtcaaaagaaagttactactcatttaaatctgccggttttacctacctctattgtattatagtatgaaaaaagatcttcctactgaccctagtgaaaatcctaaatgatcaatgattcaattacattccctttgctcaacttactaagaaaatatctaacaattagaattagagtaaggggagactagatttaaattttaattagtaggaaaattaaattaactaaatcctccattctcaaagtactttggagaattgagattttactgcaataaataaaattctgactggatttttactgaataggaaatttctccttgtgctctcattcaaagctcggtataaatgctatttagcatgtgtttttaatttttcaaagacatatctaataaaaagcagctatgaagaatgcctttgcttcatctttttatcaagtgattttgttcaagaaattctgtgtatctggtgttctgctaggatacacaaacacacacacatatatgtaaatatgtgtatatatgcataagctttatacatatattcaataatcttaaactgtgccctcaagtcaaaatctaaaatatttagtcaaacagcaacgggcttcagcatttgcatgtcccttaaaaccataggtttcaaaagaagtttttgcctctaaagagaagaatcaaaacaataatgacaaaagaaacataaaatattttgtagacggagttacaaattaaaaagcattcctgtcttatcatttaccttcaaaaagtgcttttcaagtgtttcctttccagagctacagatggtctttgccatttagcatcctgatccctgttagaagaagccaattaatatcatatccctatacttctaatcaaggctgccctaatagtgttctgctgagtgaactgttgctgattaactgaaaattagtgagtgaagctaacgattttctctctagaccctgtggacccataaaaatgttcatttgaattaaggatagttaattatggtgtatgatttgccagtagactgaacttactgagtccctgtgaggagcccaggttggggtggttgatttgatgcaggctggcaaatctctctttcaaagtctgctgttttcctcttagctcatttctcttccaggcatttccaggagatatgtctggcagctcgttcactcagcttacaagaaaaaaactccccagtgtatcacgaggggaagagcaaaatatgaacctttcgtcactggcaaagtgttccttggtgagcagcacaatttctgggggttgacaaagatcattttaattttaatgtgcttttaagctactgaaacacattgcaatcaacatggatatgatgtatacgagtatgccgcccaggttatgctgcagctgtcacagaacgatgaacagatgtgaagaagatgcactttcagactgctggtctttcaaggccccaagagaaacaaaagatggttagcaagaatatttgagtaagagcagtaaggaaaatctctaattcagtgagacaaaacatggctatgcagtgaaatgtcaaagagagaaaatgcaaacctactgaatgtgagatattgaaattcaggttgcctttttcctcagatttcaagctacagttttacacatggtattgttttgtagccatgtcattttggtacttcaataattaagcccctggaggaaaatttaagatggacttgacttttactataaggtatgaaggctggcatacctaaaatatatctatcttagatttatttagcatattctaaaagagactgcctaggcttttcttgcaatactcatgtgcatgataaaacaggagggaaatataatttataagccaaaaatcaatagtctcttgttaaagggactttggtaatcttccatttctattaactaaacctaccttttctagatatagagggctctagggccctagtgaagttttctctaagacctcccctctggtttatatttgagttcagtgccttgtactaaagagattgcctatataacagaaacaagagtgaaacatcgaaccttgttttgagctgaagaagattaacttttttattttttaaagatttcctcaagtgaggaatatggaagttcagaaatggttgcaggtgtgagcaaattagaaattagacaagcccaaaaacataatttcaagagcctcttaaaaccaataatgcaatgttttcaatgatatgcagagataatcattgaacaagaggcactcaggattaaaaaagaaatagcagagaaatttgttgaaatgtttttaaggttttaccaaggtagatgttgtgaggcatccaggaatggttgaattaaccacactttcaactgactgagcttggttgaagccctaacatccccactaatgattgatttgtgtattttggttgactcacgtatcttctagtcggtttgaggaactattacatgccagtagctgatctttctatagataaataaattagttttaattaataaggtctggccaataaggtttaaaatgagagctgaggaagagcataggttcaatttcatagccttgcctttcttttgctctcctttatgtagaaggaggtgtctgggtattagctttaaggtgactccatccctcttttcttacttagcaggaatgactacaaattgagttaggacaccaccattaaaaaaaaaaaaaaaacaacaacaaccataacccctaaaaggttttgctatttggcataggaagtccatttgtattatgtagtttagttctgctcattgttcctggaggaagatgtaaaaaagacagaaaagttcaaaagagtagcaactaaaatgatcagggggcttccacagtgtattggaatcaagtaaaagtcttcaaaagaatcatcaaacttatagattccttcacactccaatgagtttataaagctagcatttgtagttgacaattactatttaaagagtgttttcatatatataatcttccagcagcctggataaagacatcaaggcaggtattatctctattttacagaagaaaaaatggaggtctgagagatgctacgactttttcaaattctgacggtcattggtaactggaagaagccagccttgtaacctaatctcatccttttccactcttccaaattgattggattaacatatccccattcagtcttgacagggaatagccagaatgaattttcccagtctctgctctgtctctaatcatatgttccctttgacatgcaattgatagtgtatacttcaatgtctctattgtcttgtttctaatcatttcatgtgctgtggatgtacctatcatcattatatctaccttgagatcagaagtcttcaaagaaagatggcgattgttataagctttgctcaacaaaattgtattaaaataatttgaatgacctttcgttgttggcgtctgggatgttagagaggatttaagtggcctggatcaggtgtcagcaagctatgttccatgggccaaatctacttgctgcctacttttgtaaataaagttttattggaacacagccatgctcatttatgcattgtctaggtctgtgtttgtactacagtggcagagttgggtggttttaacagaaatgtacagcctgaaaagcttaaaatatttactatctgaccatttacagaaaaaaaatttaccaaccataggcctagacaattaattatatataattagtccctgaaaaatgactaaggaacaagcaatacagagtgtgttgtcttctgtttctttctagaaatttgacatcttgggacctgttgttatttgagggagaaatagtgttttttggtaaagaaaataggaggtagatagaagaaattccaagagcatttcagaaggggagttatatttagaagcattgttcttccacagtcaatcaaggtaatgaaagggagaattgcctgaggtgaaggtgtgaactagggcataacattctagaagtgtttgtaagaagctgattggtacccaatatattaaatagtgaatttactaatgccaatcaaacccaaacttttttgtttaaaaatgatttaaattattacagtctatttatgtttgcttttagtaaggaaaagagtagtagtagattttattacaggagtaaattctgaatcttgggacatggattcaactaaagtagaagttacttttgattggtgtttgcacaaattgttttgcaccagctattataaaaaccaacttttaatatcccatattttgagatttatggaggtgactttccttttctttggagatgatgaatgtgtgccgactggtattgctgtttgattatagatggctagctgtgaggaatgtggaaatgatctcagccatttaaacctcaaggcaatctccccatgtgacctaaaaggtgtgcattttatttatgtagctattttacctactcactcagatttctattgcacttagaaattcccaagtgaaatgtctacagttattttgtaaaagtcttgaaataatattcccttccttctcattctcgctcccaggaaatttttgcttaaagcagcatttgtgaaatagcacatgggaggtgccatagtatgggtgaaagagaacaggcttcagactcaggcatacctggaaggccctttgaaaagtcatgatgtgttcaggaaactgaaaatgactcaccggggctggatagtagtgcttagttgggtgtgtgaacaatgacatgtctgcagaggtgattaggagccagataatgaaggatattgtgttccatgcgaaggaactgaacagttatcaaggtaatatggcacctctgaagggttttaagacaagagtataacacagtaaaatttataatcgtgaaaaacactctggaagtagggtagatgacggactgaaatgtaaagagagtgagggtagttagagatttgaaggactggtgtcgaaactgaggttttcaaggaataataaggtctgcagctgggagtgtgtctatgagggtaggtggctgagtttaggagatgtttgtgtggcctaatggatagaacgtagcaatattaacagatatgagggtgagggaagaatgaatttggggactgagttgattataatagtaaattacagaggagaagaaagattaatgcctatcttactattgcatgcccagaacctcaccccactaagcagagtgtttctgtgtttagaatgtaacaataggagaaaacagaagtaaagaaaacaaaaatctgggtgctaatgacggtgacagcaggaaaaaggaaggatctataaagatagtacacatagctgcaaacacagttgccaagtaccagcatgaaaaattgagacaacatggtctccaagggcagtgtctatctctagacgactatgcctatacagagtttccttctgtaaagagaatatccaccgaggttccccagaaccaaaacttcagactaaggtttcagcccacatttaggaggtaattaccagcagggagtggagaaacaagaaagaaaagcaaaagtggtcaatatgaagtgtgttaatgattggttaccactgtgggaaactaggactgaatcctattgagaacctctgggaaactgggtagaacatgcctcatcattgttctacctgaagggcaaggagcgttgagtattcatctaccagttctacttcgtcattgattactgggttaaccaatggtaacttcctgacacttccaaccagccctgggctttggtcatgcatactgcattgggcaaaaattccctgagacagggagttgtggttgttggaactatgaatgccaaaacgatatgagcagagttctgacagatactcctgcatatacacacaccctaacatggttagtacatctattgtacctgtattttgagtttgaaatggtagagttttacttaaaattagacaagttacttctatgaagcagattttccatctttttttaacctatctctctgtatagacctactgggatctagaagattcaaatttcaaggctgtgtccattgtatattggtaacattagtaaatggtgatctatggtgatggaatcttttgaacaactgctgaaactataaagacaggtataaaaagtcaaatgaaactgttaaagcaactcagatgtatctggagaaagaacacattctgtactccaaaatgttaccatttcctaaaattacactaccaagatctgtgagttacacataatataaatatttagttgttgatttcaaaagaaaagaaaatgaatacaccagtatacaagatgcttaagacctagtaaagtagccctcccaactctttatttgaaagtgaaaataagaaattaaatggaaagatgagttgaaagagaacaaggatatggagagtcatatataagatggaagaattggattgactgatgagttacctggaaatgagaaaaaaagcattaagctcaacttatggcaatccagtgaagtatgtttccgtttttagtattttactttatctcttctagttccctctttaaatgcaaagacactggaaatgagttggtaagtaagtcattcctactagggtatgctaacttgtagccctgtttgtttctgccactcactggctatatagccttgggtaagttacttaacctctctgtatctcagtttccttatttggaaaaattggtgataataattgtacctacctcataggttatgaggatgaatacatttgcatatgaaaattacttacagtgcttgacacataataagaaatacattcatctcttctggataataagcaaaatgaattcaaattgttatagcttatggaatttgacataaatcacacagaagtgtatcacagtgttatttttaatgatttttaacattcaaaataattgataaaaaaatttggcattccagagccaaaacaaaaagcaatggtgggagttacagttctaacagaaggaagttttagttattagagctgtcaaacaatgaaatagattgcctttgaagtcatgtgttggatgacatgggaaatatgtaacagactggatgactgcttcttactgatgctggagaggaggtttgtgcatcagagaaaaggtgtaagtaaatgaccctttcaggtctttctaattttcagtcaatgatttcacaatttggctctaagccctctttctaatattatatcttattgtttcctcatgcaaatcctctgccttagacacccaagcacactcataaacacttaacaagtttcatgctttctcaccatttgaattttctgccactttctccactttgtctttatctttacagtataggccaaacattttgaaagtaaaagtcttagtaaaagttataaagtatatggtatattaaagcttaatttccatgtacaatattattaggacttggtttttcatagctatgctatgcttgaacctgaaatacttaaatgaatacatatgaaagatgaaaagatgagttacctccccacccatacatactcatttagaaagggataatctgtgtgggctaacacacttgaattagtaaaaatatctccaatcttttagattttttacttatattacaattcacttctgaagatgtgtagacttcaacattaaaattaaataagaaataaaaggatgtctttatacaatgcttcgtcaaaaatatatatgttaatacttccttatggaggaaagatttctgggagaaacgaaggcaagggaatgagctgctggtgattagttggtttaatagttttacatatttgtcgtcagaatcctttaaaccaaagcttggtgggaggcacagtttgaaaacttagagttgctttaattaaggaggtggtgggagaaaagaagatcctgcctggaagactaagaaggtaatgggagtgctctttaaagctgtgccaaagaggttcacaatacctttttgccatgagaatcaggaccattttcctgtcccgagggcagcatgggcttgttctcacagtcattcagaagggcaaatgagaagttttgtgtgtgcctatgagctaaataatcattttcaactagctttgtggattacaacgtcattttgtgacacaacttgagactctacactgactcctccatgtggatttcaaaacccctaaattatgccccaccatcttgatttcctagtattttatataaactcacatcaatttttccccaatattttattacgcaggacctgaagttttcctggggaaaaagtattagtgctaaaatatgcatttttctattggaaataataaaatagtccaaagatatttccccttttccataaaattccaagggaaacccacttagaaaatttagagtgtaattgaagaattctactgagcatacatgacataaagttaaacaatacttgggtagaaaaatgtttggagatccctgtcaggacataatttttctgttatttaatgaaaaagatgacttgctatggtttttaaatctgcttaaatgtgtttcatttgatcacattaatatttgtacagttatttttccattactcatgaaacactaaaaacactaagcaataattgcacatgctttttccttttatgaccatacattttcccggacaggtcttataaattcacatatgttatcaaaaacttttttttttggagatgaagtttcactcttgtcacccaggctggagtgcaatggtgcgatctcggtgcactgcaacctccacctcctgggttcaagagattatcctgcctcagcctcccgagtagctgggattacaagcacccaccaccacgcatggctaatttttgtttttagtagagacagggtttcaccatgttggccaggctggtctcgaacacctgacctcaggtgatccacccgcctcggcctcccatagtgctaggattgcaggcatgagacaccgtgcctagcccaaaactttttatgatatattaataatatgtttgacaaagcaaatactttcagtgtaattattcacattgactgaaagaatcctttactacagccctctatcttattgctcacatagatgattcattaaaaatctagatatatagatggctagacatgaatgtggtatggttctcagagcataaggtctcctagatggagtaacggaggagcataacctctccgttactcaaggactactcttatgcctccatctctaactcatgggaggaataggaacattgaacagagatttggtgccttcctttactcacagcttgtacacaactcactgtgatggtgatgtgtttagcctgtgaacctatgtaacagaactcgacaggcaaaaaaatagtttccttccacattaaaaagcaaacagtgcagccatagaaaagaacgagatcatgtcttttgcaggaacatggatggagctgaatgctattatcctcagcaaactaatacaggaaaagaaaaccaaatactacgtgttctcacttataagtggaagctaaatgatgagagcttatgaacacaaagaaggaaacaacagacactgggggtctacttgagagtggagggagggaggagggagaggagcagaagaggtaactatcgggtactgggcttaacccctgggtgataaaataatttgtataacaaacccccatgacatgagttttcctatgtaacaaaccttcacatgtacccccaaacctaaaatgctaaaaaaaaaccaaaaaacaccccaaaacaaaaaaatctttacccccaaaaccaaataaaaaccccccttgttttatctaaatcattattaaatgcagtccttccttaaaatttttacattttgttatatttacataacgataaaatcatttcccacttgatataagaacaaaaatctgttaattcattatattattagaataagcaaattaattactgctaacatcaaattcattttaatttccatgaccgtcatatagagttctatacatagagagtggaactccacaatgaaaacgtgcttaactctttttatttcctcctcacagcatgttctgctttaatgacatattgagggaataaaatacatggaattttattctagtatcaagtgagattttaaaatatatgtgaaaatatttgataaatgctttttttcctaatgggtgcacttagaaattatagttttaggtatatttatattttggccatatagtctcttaaataagtaaaacaaagcatactgtaacaaactattttggtcaaaactctaaacagtatatagacttcaaaataacttactcaaaattcatgagatttagatttcatgctcaacttatcaggaggaaacacatccaaaatagaagtgggttgactctataacttctactcaatggctatatctacataactgtgaattaaaacaaacaaaaaacaaaagctagaaaactgaaattggttcttagtcattatgtctagttatgacaaatcgagacactatgagatgattttctcctccggaaaccaggcattcaaagacttccagtgactcaggatgggagtgtacagaagagaaaagaggaacgaagaaagcactgatgcaagaagacacaattcatcaattcataaccacaccctgatctccactaccatagcattacagccatgatctctttcagccttctctctgccactattgccctcagtgctgattttaatagattttacctctttaggatggtagtgatgaggagggatactgaactaccgtgatttgccgtgaattttcctaggaagggccccaggggtctgccatgtaagcgtaacaactcttatgtgagtgtatctcactttatacacaaacactgtaataatttaatgttatacatttctcaacctgatattatttccctttgattatttaggttgcacctacctcatgagaaagatttggagaaggtgtgaaaactttatcccaaatcttagatgctctataaatgtcttccattttataaaggctatctgaaagagaagcaaggacaattccgaaaaattcttcaattttaggtttggtcaaaccaacaataaatacaaagaaatggcttcatctgagtaactgatacttccaagacttggccattgcagtcttttgtagattatataatttactagttagattaaaaattatggcaggaggaaatcttagaatgctttggctacctatctacggatacaaaaccatggtgtataattccaaccttattaaagcattagaacattggtttttaactctctattggattaggaccaggtatactggcacagctcagtaaaacctaagattggaaataatttgaaatctcaaagtcattgtcaccttacccatttcacctggctaattacttcctctcctttcatacaacccaacaaatatgtattcacattagtggggaaaagaagctctccctatatttacacaatggagtgatttttgcccttctaattaaccagcatgagtcaaacgtttaaaaggttccagaagaaactgtgccttcaattaacattcacagtttctaaattaatcactgctgaccttaacatgcaggagtcttaaagacatgtttcacatttaaaaaatggtaattttattcaaagaaatctaactacctatgtttcataagtgtttggtcattgtttttctcctatcactgcataaggagtcctagagtttggagcattgtttcatcacatctctggataaaagccctacaaatgatcttgagcatgataatgatattgtcttcaatataaaaattaatagtgactcattatacactttgaaaaatccataccatgctcacttcagcagcatatatactaaaattggaatgatacagagaagactagcatgatccctgtgcaaggatgacacacaaattcatgaagcattccatatttttcaataaatgtccccatcggcaagttagaaagatctcaaattaacaacctaacatcacaactaaaagaactggagaagcaagagcaaaccaaccccaaatctagcagaagacaagaaataaccaaaatcagagcagaactgaaggagaccgagacacaaaaagccatccaaaagatcaaggaatccaagagctgtttttttttaaatattaatataattgatagactagactgctagctagactattaaagggataaaagagagaagacccaaataaacacaattagaaacgacaaagagaatgttaccactgaccacatagtaatacaaacaaccatcagagactactctcaacgcctccatgcacacaaaccacaaaatctagaataaatggataaattcctggacacatacacccttccaagactgaaccaagaagaaactgaagccctgaacagaccaatagcaagttccaaaattgattcagtaatgaacagcctaccaaccgaaaaatgcccaggaccggaaggattcacagccaaattctaccagatatacgaagagatagtaccattcctactgaaactattgcaaaaaaattgataaggagggactcctccccaaatcattctatgattccagcatcatcctgataccaaaacctgtcagagagacaataaaaaagagaaaacttcaggccaacatccttgatgaacacagaggcaaaaatcctcaacaaaatacttgtaaaccgaatccagcagcacatcaaaaagctaatccaccacaatgatgtaggctttatcctgggatgcaaggctggttcaacacacacaaatcaataaatgtgattcatcacataaaccaaactaaagataaaaaccacatgattacctcaatagatgcagaaaaggctttcagtaaaattcaacatcctttcatgttaaaaacttttaataaactagttattgaaggaatatacctcaaaataataagagccatctaggagaaacccacagccaacatcatactaaccaggcaaaagctggaagtattccccttgaaaactagcaaaagacaaggatgccctttctcaccattcctgttcaacatagtattgcaagtcctggccagagcaatcaggcaagcgaaagaaataaagatcattgaaacaggaagagaggaagtcaaaccatccctgtgtgcagacaacatgattctgtatctaaaaagttttcacagtcttggcccaaaagctccttgaactgataaacaacttcagcgaagtttcaggatacaaaattgatgtgcaaaaatcactaacattcctatacaccaacaacagccaacccgagagacaaatcaggaacacaatcccattcacaattgccacaaaaagaataaaatacttaacaattcagctaaccagagaggtaaaatatctccacaatgagaattacaaaacactgctcaaagaaatcagagatgacacatacaaatggaaaaacattccgtgctcatggataggaagaatcactatcattaaaacagccacattgccaaagcaatttacaggttcaacgctgttcctatcaaactaccaatgacattcttcacagaactagaaaaactattttaaaattcacatggacccaaaaaagagcccaaatagcaaaggcaatcttaagcaaaaacaaaaaaggagggggcataatatgactctacttcaaactatattacagggctacagtaaccgaaacagcagggtactggcactgaaacagacacacagacaaaggggacagaatagagagagcccagaaataaggctgcacacttacagctacctggtcttccacaaaactgacaaaaacaagcaatggggaaagaatcactattaaacaaatggtgctggcataactggctagcgatacgcagaagactgaaactggaacccttccttacaccatatacaaaaatcaactcaagatggatttaagacttaaatgtaaaactcaaaactataaaaaccctggacgataacctaggaaatatcattctggatataggaactggcaaagatttcatgacaaagatgacaaaagcaatcgcaacaaaagcaaaacttggcaaatgggattcaattaaactaacttctgcacagcaaaagaaactatcaacagagtaaatagacaacatatacagaatgggagaaaatttttgcaaactatgcctctggccaaggtctaatatccagcatctataaggaacttaaatttacaagccaaaacaaacaaccccattaaaaagtgggcaaaggacatgaacagatactcttcaaaagaagacatacatgtggccaacaaacacatgaaaaaaagcgcaacacccttgtagcatagtttgaagtcaggtagtgtgatgcctccagctttgttctttttgcttaggattgtcttggctacacaggctcttttttggttccacatgaaatttaaagtagttttttctaattctgtaaagaaagtcaatggtagcttgatggtgatagcattgaatctataaattaattcgggcagtatggccattttcacgatattgattgttcctatccatgagcatggaatatttttccattgtttttgtcctctcttatttcgttgagcagtggtttgtagctctccttgaagaggtccttcacatcccttttacgttgtattcctaggtattttattctctttgtagcaaagggctaatatccagaatctacaaggaacttaaacaaatttacaagaaaaaaaaaacaaccccatcaaaaagttggcaaaggatgtgaacagacacttctcaaaagaagacatttttgtggccaataaacatatgaaaaaaagctcatcatcactgatcattagagaaatgcaaattaaaaccacaatgagataccatctcatgccagttggaatggtgatcattaaaaagtcaggaaacaacagatgctggagaggatgtggagaaataggaacacttttacactgttggtggtattgtaaattagttcaaccattgtggaagacagtgtggcgattcctcaaggatctagaaccagaaataccatttgacccagcaatcccattactgggtatatacccaaaggattataaatcatgctactataaagacacatgcacacgcatgtttattacagcactattcacaatagcaaagacttggaaccaagccgaatgcccatcaataatagagtggataaagaaaatgtggcacatatacaccatggaacactatgcagccatagaaaaggatgagttcatgtcctttgcagggacacggatgaagctggaaaccatcattctcagtgaactaacacaagaacagaaaaccaaacaccgcatgttctcactcatagatgggagttgaacaatgagaacacatggacatagggaggggaacatcacacactggggcctgtcagggggtggggggctaggggagggatagcattaggagaaatacctaatgcagatgacaggttgatgggtgcagcaaaccaccatggcatgtgtatacctatgtaacaaacctgcacattctgcacatgtatcccagaagttaaatttaaaaaaaagcacaacatcactgatcattagagaaatgcaaatcaaaaccacaatgagatacaatctcacgctagtcaagatggcaattatcaaaaaatcaaaaaataacagatgttggcaaggttgtggaaacaggagaatgcttatacaccattggtgaaagtgtaaattagttcaaccattgtggaaagcagtacaggagttcctcaaagagctgaaaacagaactaccattcaacccagcaatcccattactgggtatatacccaaagcaatataaattgttctaccataaagacatgcacatgtatgttcactgcagccctattcattatagcaaagacatggaagcaacctaaatgcccatcaatggtagactgaataaagaaaatgtacatatacactgtggaatactatgcagtcatgaaaatgaatgagctcatgtcttttgcaggaacatggatggagctggaggccattatcctaagcaaactaatgtaggaacagaaaaccaaataccacatgttcttacgtataagtgggagctaaatgatgacaatacatggatacaaaaaaggggaaaaacagacactggagtctacttgagggtagaaggtgggaggagggagatgatcagaaaaaataactaatgggaatgggtacaaagtatagtacttgagtgatgaaataatctgtacaccaaagctccacgacacaagtttacctatataacaaacctgcacatatacccctgaaactaaaaataaaagttaaacaatcataaatacttagaaaactcattcatttctaaatatatattgattcatgttcagtaaatatctaacagcacttaatatgtacaggtactactgtgctggaaatacaaaaaagcatggtactactataaaaataggcacatagaccaatggcacagaataaagaacccagaaataaactcaaatacttacagccaactgatcttttacaaagcaaacaaaaaaataaagtggagaagggacacccttgaacaaaacagacaaaaactcctgcctctgtgaaatttacattcaggggagctatatacaacaaaagtataaataagtattgtacacactcacccttcatatccataggggaatggttccagaaccttccatgcagccccaaatcagaagacgttcaagttccttatatgaaatggtctaatatttgcatgtaaactacactcatgttctcatttaatttaaataatctctagattatttatgatacctaacagaatgcaaatgttatataaatagtttttatactgtattgtttagagattaatgccaataaataaagtctggacatttaaaaaagaaaagaaaaatccataccatactatatttcacatcacctgcattttcctgcaggaagacagcggcatacaaatttcagaatattcttataattttctttataaaagtggaattattacaattgttaaagaaacccaaatgcaggtggtttatattgaaaatcaaagtaaggagttcctgatgggaaacattttccatagcatttcaaggattcagagacactaatgtctactttctttaagaaatcctaactctggggagactcaaagattgaatccacccaatcttacaatgaggaaaaagaaagcttttctaacagatttaaaaaaacactgcctatgatatatgcagccagggacttcatgcattatctaaagctacgaacaaaaatgtgtgaggtaaataactttatttgcgaagccctattattcaacctgttgttgcctaatggtactgaggctagcgcccttctaggagcaaccctgggctcatcttgaaactctggtcctgtatgtctgactctgcttcttgaactctcttattctgtgtatagtacgtttgtcctcgatggcagaaacctggttcatatttttctctccctttgtcatcttggattctgtgctacctatattgtatgttaacttgatactggaaaataaaatgtcactgcttaaaggaaccaggatgttagcactaaaattctaaagtcccatgtagttcaaagttttttttttcacagatgaagaaactgtagcccagaaaaatgtgtcttccccaaggtcacacagttagaaatagtttgttacaataaaatttcaccgatcggtgtcccaatttcatatttagacctcctcctgttaatgaatttttgtcatccagatgaattaatcccacttcagctgtttaaagagaagggtgagagtttctctccacatatttctttatcttccttacacacatgcccattctaaactatatcctgcagacttataaagcataccccactgacagggttaaatgaagacaggccgaatgtgtggcaatatcagagaaatattcccctatataagcatccatgggtgttattcatactatatcaagtgattagaaatttcaggaagtgcttacttaaacagccagtgtggtggtaagcagaacacaaatcttaacccggagacagcgcaacctggaggctggttgcaacatttagcaagttctcgtaaggaagcattcatgaacagattaaaatatcggcaaacttctccccaaaaataccactggaaaagaatacctaaacactaatttgatgatgacaaaataggttttcttttctaataagttctagtttagggaacttactgtattttacccattttcattgaagatgagaaaaactgtaacttaccttctcgctgactcaaaaagtcatgaaaaattttacagatggtttatagataggcccggagtcatagatgatacctgtaactgccaaggaactgcagttccaaggtttctcaaaactcctaactaccaactatgctgcttcctctagtattccatgttacctttgccctgaaaaattaataattgtggtagtttatttttcagtaaatattcactccctcctcccctcccttattttatatttaatatttatattttatatttccatatatattattatatttgcatgcctcattgatgttggacttcgccatgtcatttactgtagccaatgtcatgtcggtgcatttgactgtgtgctaagtcaagattatgccttaagcagcgttacttgttttgttctcttctctgggagcttttgaccactgacaccatgagaaaaacatgtaggcagtcccctggcttaagcataaaagacaagtggaacaggcctgaatcaaccccgtggcttggagccaggcccagctgagctcagcctatgtcagctaaactccagctgaatcacgcataagaaattcttcttattgtatgccactgagaatttctgattgtcagcagcagtagctgactgatacaatagttgtcccatatgttattccatttgttactttgtaaatctttgctgattttccatttctctatattttaccttcccaatcagtttgaaagacacctgggcagcttgatccatgttttaacttatttggaccccaaagtacacaccactataaccactcaatatattctagttgcagtcacgagtgttttcctggtaccgtgcattggagtaagtctttgctgtaccattgatagccctcaacgacaaatgctgcatttcagtagcaatctcagaatatgttttagaagcatagaggctaagtaactcaacagaataatcagtgaaattgagcaagtggagaattcttcatttggggacattgctggcattttaagacacttttccattcatggtagaacagttattgcacataactgaaaaggccatttttctcaaggtaaaattgctgatttcaggagcacatggtctgaaaaagcttttatgaagagagcactattttcccattggatttctccatgaatctggtatttagaactgcccaaaggctaagggctgatatatttgctattatgtttcacaacagggcacagatgaagcaggacagggagcaaggcgaccttcaccttcatatatcacatatatacatgttgtacctcacatatattacatacaattacataattacgtaatacatacatgtacttacatataccatgtaattataagtaatacatacatgtaatatatgtcatacactgttcatgttgggaaaaacaatccagttagctttttgaggtgaattttctttattcatctgagaaatggcttaacattcccaagtaataccaattctgctataggatgacaggcgtttagggcattaaagattattttttttaaatgtattaagggagagggtaaagaaatcctagaaacccccaaattgtatctatcagtggcagcagatgagtgcttagccagtttactgaaaagatttaattacatctctttcttaccttgaatgtctgcatggatttgacataccgcttaaagcaatgattttgacataccgcttaaagcaatgattttgacataccgcttaaagcaatgattgtccaaagaacaaactcttcctgcggctagtaaaatgagtcctcttgacagtaagacttactaataggaaattaatgattgtcaaatctagggctcaacaatgacaaagctttttggaacttgccatatactttctgtgtgacattttcagctttaaatctttgcccattctgctctttgaaatcttgatatgtaagatctggatatgtatgtcatcatggaagcacgcctagttaagatctctgcaatctgattaaagaggggagaagactgaggaaataaacaacctgtttttgtatatgtgctattcctaactttaccaatgttagtgagatccttttcccctgcagaagagctgaacaaactagcaaagattcgccagggcttgaaacaacaatcagagcaaatcctaaggaatttaggtaacagaaaggtaaggttctaattaaaagagacattaaaacctctggtattctacaatattttaactcttagcttttcactgccattattggtttttgccttgagatactgttaagagtgggaatgtttcaggatattttgtaggctatgggaaatctttgcttgttaacagattattgcagtttgtagaaaattatttgagaacctctgtgactcttcaataatcctattattttaaaaacaaactccttttcttgtcattcgtcccaaaggcacttggaatcagaatctcttgaagagagagaaaacacagcttctttaccattcgagtgtttttgtgtgtgtgtttgtttttctgagctcaggaatgaggtaatgagggcaagtcggaaaaatgtttgtggctaggctggaaatcaatggaaaacaggttatggttttacaacaaatcaagtgtcacagatctgctttgtgtttgggagttaatctactctctctaaaaattctccaaaagccagttaaagcaaatgaagcaagactttgcaggaacccccgagagagaacacactgctatgtcacacagctctcacaaacgagtgggagagattgtctgaaatgtgtgttttacaacagatgccaattgctctgattcttgccattaacaacttcagaattagcttacaaatggtaatcttcacagagcagtgacttctgtgtgggaaacccaggaagaaaagtggcttttcagattttttttttttcttttgcagctgaacacaaatgagcctgggagcctctctgcactgtgtagaaaatacaactatattcatttaagtgtatgtgtggcattaataattcagagaaagtgatagtcaagggttggagagaggctggaaatcaactttgaaagcataaaagttgaaagataaagtgttgaaaatctccttggctatttaaaaactcatataaaccagtagttggaaatcactattttggtgttcaaattcttaacacctccatttttctgcttaattccaaataatactcctggatataaaattggaatagggctgaaatattagaatttgagacagaaaaaatgctgtagtggtatactttaaagctgaggccataagtaatcatgaaaatactagtcactggtttttacattactaacaacaacaacaaaaacaaatcgggacagtaagtctactgtatttcttcccatttgtttaaatggtatagtgtattacagcatgacgtgactctgctcagaaatgagacagaagggaagattgcaaagaagactaaggcagaaagaaacaccttgtcactcttcagtggtggaagagatgtggggtagataacgccactagagacagatccccaagtcatttttatttgcttggaagtacattgcaggctctttacagttttgtatttccttctcagtggtacctctttcaggctgatattagcatgagggattattcaattacagggagggggacaaatttgagggtgttattggagggaaccaaacagctcagggagcaggaaaatggccaacagtaattaaatatctgccatcattactcccagtggcgcacatccgtgtacacatattcggaggtcaactcgttgatgatatatattccagtagcacccattaaatgagtaagcctcctccccaaatgtgaaggcattcagctttctgtgactaagaaaactaattttgggaatgattttcatcatcataatggatgagaagcactgatagagcatgaatgatacgttcacatctcatctcagaaaaatccagtgcttcaaattacagtgcttgaaattcagggaccttaagcctaacataagaaatttccttggaaagagtctttccctgacaattaaaaaaaaataaaataagcacatttcacctgccttctcaaataaaggggtctctaggcttatatttaaattgatttcactcctttctaattcctggacaagcacaggactcttgtcattattgaagagcaatctaattttaaaatctctacacctgaaatcacctcttactagaaacttttcttgctctgttttcacttcttctgaacctgttcctttattcttctcctgactcctattctatctttccccagctcactctcctccattctgatttcattcatcattctatcagagatttcagtgactgctcagtgtgctgaatgtctttcaaatacctccataaatccatgactcacccttttccaccctgctctgttgccactgaaggctgatctgaattttctgccttctggttgggtacggtcaatgagaagcattggcaagaagctagaaggagtatttattctctcacttccatttttgtcgggtcaccacagttagctatgttctttgagcacatctcctaacgggtgccccgcaagtatcctctgtggaatccagtaaccatgctctcccccgtctggttattccttaataaggacagcagctgctccccagtattgggagccctggtatactgtactgtcttttacaatttccttcaactccgctcacaaccttgtaaatcgtttattaaactctaaattccagggttttagggtcccatctgtttcctgctggcaatatgattgacaaactccatatagcactaaatcctttgctcctttaatgccattatcaattcctgtggtagacagaccctaatgtaaccctcaatgacccctgccttctggtattcacgtctttgtatcatcccttttctttgagtgtgggcagaacctgtgacttgcttctaactaacaaaatatgtcaaaggtgatgggaatgtgaatctggtaattatgttattgatatggtttgggtctgtgtcccttcccaaatctcatgtcgaattttcatccccaatgttagaggtgggctgtggtaggaagtgattggatgatgggggcagatttcccctttggtgctgatctcacaatagtgagtgacttatcatgagatctggttgcttaaaagtgtgtagcgccattccccactctctctccttcctgctctggccatgtgaagatgtacctgtttcccctttgccttccaccatgattgtaagtttcctgaggcctccaagccatgcttcctgttgagcctatggaaccgtgagccaattaaacctcttttctatataaattacccagtttcaggtattctttatagtaatgcaagaacggactaatacagttactttatataagactctgtcttgctagtctctttctccttctcctccccattctctatttctctctctctccttcactttgaagagatgagcagccatgttgtaaactgctatatgaactatgaactatgaactggtctgcagggcaggtaattgtgagcagtctgtaggagcagagggcctccatcctacagctataaggaattgaattatgccaaaaatgtgagtggccttgggagcagacctttccccagcagaggcttcagatgagaatttgagcctggcagacatcttgattgaaacccagtgaggcgctgaagcagcaatctcagttaagccatgcctggaatcctgatccacagaaacattgatacagtaagtatacggtgttttaaggtgaaatatttttgttaacacagcattagaaaactaacgcaatctcaatcactggaatagcctctggtaggcagtatactttcctagttcctactgataggtaactgaatatttctagagaaaaatcatgaaagaatgctgactgaaactggaaatcatgtatgtcccgtggttttagctaaaacactctcagtaacccttccttcatatcttcttgattcttgagtcttgagcacccccccccccaattttatccttgaattcgcttttatttccttcttactgagtagcctataataacattccatgaggggaaaagccaggaatgggaatgttcatcttggccaaatcaagtgaaggagaaaaggtttaggcttgaggtttgtcatccatgggttcatcagtgtacagaaactaccgtctcaaagttcatcagtaacctcacaggtgccaaattcattgaccaaaagttgtaggccttcctctgaagtcctcgcagcattttgccaatagtctctttttgtgattccctctttcttggcactcttgagcccacactcttctgccgctatactaccctctcccatttttcttgatcttattctaatttattaaatggatgtcttagacattaccacttctcactcatgttcagatttcatcttcatcccaggtttctgaaggattatatgtgtgaacttcttgccaatgcttagctttggccaaatccaaaaagcaggcagaaagtttagttaggcaaggccatatgatgagttctacccaaaagattgtgagggggaactgatggctgtcacttacaggctgaagaaattaaaagtcactgtgagaccctctaactctctcttctcctttcttggtgagatgttgagatgttgcagccataagatggaagcacatcctggttctctgaggcccctgtggaggaaagataccctggagaattgttgaggctccatggaacatcgcacaagtgagaaacaaattttgttgtattaaatcattgaaacttcatagctttttagttaaagcaacctggtgtatcttgactgattcagggatcattattcaaacttcctcctcgtattctttctttcacaatatattcatatactggtcaatgccattcatccttagagcttcattatcacttccatgtcaagcatatctaaattaataaattcaggcagactcttttcagcgacttctaattctgcatgtccaattgctcattgggcatccctttgctgatgtccttctgaaacattaaaattccagtgtacaaaaccaaacccatgttctttccctcacatccaggcccaccttgtgatatatctatttctattaaactcccgtgttgtgaaaaataaaattactcctcagcatatgcaatcacctagtactacctgttactccatctcctgggtaactctccctctgccatttctgattcctctgcttggtccctcactggatctcagtcatctgcagctagagagattaagacatccactgtcatcactccactgacgcactcttcctaaaaacaccaggaacccatacagtggacatattttaaaccttataatgctagatttttcttctgtactaacactagttatcattgttatcctctaaaaacttgattctcttcatctctgtgatgactccttttacatttcagttataggcttctcttctgaccaggtcttaaatgtcattgcttcccaagcatctatccttacaaccttcctcttcatgggtttctctgaatgctttagtcttttcccacggctttaaatatttctgcacacaggggacgtgtttatctcaggctgtggtcttgccctttctcccaaattccacccgttcactggatccttacacctacttgaatatccctcacgtactttaaactcaagattttcaaaggtgaactcattgtcttatgcctaaacgtctttcttccactgtatttactttggcagttggtagacacccaagatagaaccatcagatttagatcattacctccatttacttccccacattgtttaatcaccacatcctgctggttttgcctcataaaaatttcttcagcctcttccttcaactccaccattgcccactacctactgcccccatttaggtcttcatcttcattttctttgactattacaatagtgtctgagtagccctcctgcctccaaccttattcccttcaaatatctcctcccacttcagatggcctggatataagtatgtccccaatttgagttccttagctctttaccacggcccatgggataaaagtgcaaactccttaacaaaaggcaagcaaggcttgtcgctgatgtggccccatcaacctctctgttctcatctctaacctcttatcgagttatattactcaaaaactaatttatgctaaatgctcttgctaatcttcccaaagcatagctcactctttacattaatatgctcaaaagcatcatcttcttattgtctatcgaatggagactgaccttttagccttggaattcaaggttctccatctaaactctgggattttaccactcatgatggaagtttcctaaatagttccaaataaagaacatgtggggccagaattgcttcagtgactcataactctgggcttggtaatgaaggacaggaatgagactacaagtagggatcgagcgaccccagttgtgagaagaaaaatgagggctgccaagcctacattgtgacagacatttttacactgagtaaaccaagtctgggaaagtttaagtctcccagagttacaaacttgataatgtaagaggcaggtttaaatacctgttctctttcaatctagagccccatttattgctggtgcacaaaacgccttccagtatttccatattgaatgtttattctatcacaatcctactcgtatttccaggtgcagccagaatccacaaagactttcttgaatcactcaatacatggtcatgtattcattacagaactatctgtgaaaaatggaaatattctctaactttgttttctagcctaggagctactagccacatgcggttattgagtacttgaaacgtggttagtaggactgaggaactgaattttaaatgttatttaaatttaattacttaaattcaaaggtgattagctgcatgggtctagtggatctgtagctctagatttctgctattcaaaaatggtcaatctgcattggcatcacctgggaagttagtagatatgttgaatctcaggccctacctcagacctgctaaatcagaatttgtaacaagttctccaggtgattcatctgcacattgaagtatgagaaacacttctctagggcatttgttagcagtagtttatggcttttcaaaaaccatatttcatatcaagttttataatacaggcacctagaggggaggaaacattcagatagctaagtaactatttgttgaattaaacatagcctgtatacttaaagaatctattatatatgtggaaaataggtggccatttctaagagaagagttctgagcaaacaaagaatacagcatatataattataaagatcttcccttgagacctggccccagttgattcaataaacacatattgattaactgtgatgtggcaggaatcttctagggacaggaaatatagtagtgagtatgacataatccttgcccatatggagctcacagatgaggaaaggagagcaagtgttcaagtctaaataatctgtattataaaaaagcaaagtttctattggtccacaatcactgatttcagtatcattttaattcttaatattactaagttttggctgggcacagtggctcacgcttgtaatcccggcacattgggaggccaaggcaggtggatcatgaggtcaggagttcaagaccagcttggccaatatggtgaaaccccatccctactaaaaatataaaacttagctgggcatggtggcgcacacctgtagtctcagctgcttgggaggctgaggcaggagaatcgcttgaaccagggaggtggaggttgcagtgagctgaggtcgtgccactgcactccaacctgggtgacacagcgagactctccctctcaaaaaaaaaacaaaaaaaactattactaagctttgcctcaggaaaaacaaacaaacaaaaagataagcatttaaactgaagaactatatttgcattccagtagttctcaggagggggtgatcttggatcccagggggatatttggcaacaacatctggatgcatttttggttgtcacattgtggagaagtgttacaggcactgaatgcgtacaaatcaggatgctattaaacatcctacaatgcacaggatgcccccactccccacccccaacaaataattatctgacccaacatttcagtagtgtccaggttgagaaaccttgctccactctttttgaatggattcagagtaaaacagttcaatgagaaagatgtctctatttttgatggaagaaacttgaagaaaatggaccagtggaatagagatctgagtcaccaccttggcttcttccatgaatctgcaatgggagctccagtctaagaagaatcatcaccagctacaatagctcccaaaagaatgctcaagagaggaccttttgggggaattgcattgtggatgtacttcttccttctttgatacctctacttgaataggtggcttagtttccttttttgagatcctggagttctctgcttaatttatgtgggagagtagcagaaactggaatacacttttcgccacaccttttgacaggagtcaaaaggatttaatccagttctcaaacccaggctgcatgtcagaattctctggcaggcttccttaaaaacattgacatgggtgacatcagtgaaaatgttggagcacggaactctaaaaaactgccttttggggaaccaagggcccctttggctaccagccaggctctgctcaaggacaccaatccttcgtttccatcatgttgaggacctatgacctttgagctaccttaagtatttgtgatagagacctaggggccctttcagtcacctgccagaccaagcacagagagctgaggtccctctgagccactagcctccgctcccactaagttaagggtggaccttctggccatgagtcagttctctgggtcactggttgtatggcagaatgagaaaccgggaacctttcaggccacaagttgggaaaatttggctccctttagtcaccatcagtgcctgcagatggtgctctgaaggtccttccaggcaccactctgcctgtgcaccctagggttccagccttcccactcactgaggaactgacagcactttaggtcatctgtccccccatgcactgtggccctggaatcctttcctgcctgcctgctgggattccgggaccctttgggccacaagtctgcccaagtgctagagaactgtgactccttttgtccaccattatagcctcatgttgggtgctccaggaaacattccaggaattgacctgcccatgtgctagcgtcttggtattccttctgaccacatgccatcctgcttgttggggagccaagggcatttttggctaccttccctccaatgagggggtgcccagaggcctttgagtaacttgcctgtctgcacactaggttatggactccttcagaccgtcagcagcctctatctaagctggggaaacaaaagtcattttggctaccgtatgaccctcatggtgcaaaccagtggaatcttctgctcacacaccaactgccctttcgaggtctcgagggctttctggccatcatccctctacttgccagttatcagggccacatgcaggactctatattcacgggcacacaggaaatgggagtgtgtgcaccggcctgattttagtatggggaatacctgcccccttcagccaccatcagtgccttgaagttcctcctggccactagacttccctagcacttgggttccaggctcctcctgcccactagccttccaacttgctgtggaactgaaaccattttggctacctttccttcactgtgctgaagcacttggggcccacggaatcactagaatacccgtctgctggagttgggaggattcttacagccacaaattagtctgggttcctggtgaagggagattcctctcagcctttgtcatttatatatgattgttccttggtggcattcctagcaccaatttgctctaggactagggctctggtcttcttaaggctactaacctttccgcttactgaggaaccaactgaagtttcagccacctcatctctgtggtactgttgacactggcatccatccagtccctaacctgctctccccatgcagttttgggtttctttggggccacgagcttgcctgcgcgctgggaaattgtggctccttttagccaccaccttatccttcccccagccacctggggaaacttccaggcagcaacctgaacaagtgctatggttctgggtgtttttcttgccatcaggcttcccctttgctgctgaataggagagcattttaggccactttcctgcatagcgctgctgtctggggagcccatcttgtcactagtctggctgctgggattcctgtcactctttgctccacaggccagcccatgtgctgggaaactatgactctttttgctcatcatagttccttcaaggtagtgccctggaggtaccttctggtttccggtggtccttcaggccataagcttcccttgagctggggaaatggaaacttttcagatccctttcttccagtgatctgatgccacgtgggccaaccagtcaccagcctaccggtatgcttaggttgtgggagatactttaggccataaccatgctggtgtttttgggaaacatggctcttcttggcaaccataataccttattgagggtgccctgggcataagccttccctgctgctaaggttctggtcagcttcccagcaccagccttctcccttgttggggaaggggactttcaatcaccttcgctgcagtgtgctgatttggaggggagaagggtgatgtggggtgcccatctggtctatagcctatccacttgcagaagttgctgtcatcctttgccacaacttgaccacgtgatggaaaatcttaatttctttcagccaccatcacatcttcctgtaaccaagtatctcagccttgaaatgcattttgaaacctttttctttcctttccttcctaattgcataacgtagccttgtactttaaaactctttgtttctctctctctcccaccaggcacatccgtgcacagtgctcatttatctaattatgcacttgcttagaggtttcggggactggctcacacctgtaatcccagcactttgggagtccgagactggcagatcacctgaggccaggagttggagaccagtctggccaatgtggtgaaaccccatctctactgaaaatacaaaaattagctgggcatggtggcacatgcctgtgatcccagctacttgggaggctgaggcagaactgcttgaacccaggaggcggaggttgcagagagctgagatcgtgccactgcactccagcctaggtgacagagcgagaccctgtctcaaaagaaaagaaaagaaaaaagaaatttcagaggctaattttgaaacaaaccaggcatggagacccagctgtgaaatcctcccacttagggagagttatgaacagttagtccaccactaccaaaccagacctccagatggatgggcgattactcaagatagccattgacaccactcctgcaagtttcctagaccacgttttcattcttaaaccccttcactcagcccagaaagctagaatgatcttttaaagtcatgaacctggccattcctcaactgctaacatttgaagaaagttgcttttgcttcttaccacacctggcttcttatgttttcagcctctaagtggcaagcacatggacttgagccagttacattccaattagtgcctccagagaactttccaggtatcagcctgcctgcatgcctggatttcttttgttcttaagctcactgaccttcccccttgctggggaaacgggtgaagttttgcccacctcacctgcagtgtgctgctgctctgggacccatctggtcactagcctgccttccctcatctatttcttggggcacaaacctgcagacatgctgaagaactgtgactccttttggccagagtcttttctttgccctgtccccctagagaaccttccggccatcagcctgcctatgtgctatgtctccagttgtccttccagccgtcagccttccccattactggcaaacttctgtcacttttggcttccgtctctgaagtttactgattccatgagtgcctgtctggccgctaatctgtctgcccactgagttttgggggatgttttaggtcacaagccatcccgtgtactgcaaagctgtggttcatttctcccttagtcatattcttgcactggtgcccttggggaaatttctgggtaccagcctgccaacatgggacagttctgcttgttcttctagccttctcctttgctgtggaacagagagcactttaggtcacgtttcctgcatagtgctgatgctagaaatagctttgtgggagattttgatgaagtttcatagaccagtgtttaaaagtaagagtgaaaatccatggatcctaggataattgcttcaaacgttgttacttaataagagccaaaaagttactctttcaaagatgtgagtgaaacagtgattttcacacgactgttctggaattcctcttaagattactttataggattgaactccacatgggatccttgtagaacagtgtgccgtgcagtccattgctgttctacccctgaccacctaggaaagcaatattggctgagtgctgtttgcatgtacacctgaaataaatcccactgtagtttctagtccagtgagaaactaaatgaagcactaatggtaaagcaggagaaagccaacagcaaaataacagtgttaatgaatatcattgcaaatcctcttctataatcctgggcttggcctgtaagcaacagctcctcccaaagcacacattctgctatcaagctatgaaaagacatggagaaaacttactccatattactgtctgaaagaagccagtctgaaaaggctacctactgtacaattccaactgtgacattctggaaaaggcaaaactgtggagacagtaaaatgatcagtggttgccagagattatggggaagggagaaatgaacagatagatcgcagagaatttttaggacagcgaagctattccatatgataccataatgctagatacatgtcattatacgtcgaaacccatcgaatgtacaacaccaagagtgaatcccaatgtaaactatggacttgggtgataatgatatatcaatgcaggttcgtcaactgtaagaaatgtactttctggtgggggatgctgataatggtggagtttgcaagtgtgggggcaggaggtatatgggaaatctccgtactttcctctccattttgctgtgaacctaaaattgctctaaaaaaaataaagtctattagcaaaaagaggtactcattccgagagattacttcaaagtcacagctgtaatcagataatgagatcatgcaactcaagttcccatggtttatgtcaacaaaagagatgttatccctgcaatttcaattgccaaagggatgtttggattataaaaaacatccctgaattatcagtataagaaaatggacacaagtgctggctaaatataattggttaaagttatggtacagaaaactgtatttttccctatttaattttatttgataggacaaaaaattacttgccaatcgcttcccctgctgtcatgctgtgtttcgagcctcattatgctgaactctagtacacacctattattcttcaatttttctcttaatttattcaggtatttctatgattcttaatttttacttggccctgaggatatgaagaaaaaaaaaaacacaaacccacccccatttcttgtttccaagaaaaatggcacagagtcataggaaaacatggacgaaaaggtgcactttatcaattaagaggagggattgtttagagtttttcacttctagagaaacgtctcaataaagtcattttatgaaccttagttttgagacagtacagttgaaaatgtatattgtgaagccttaaaacaagttcttgccactgctttctactctatccagactgtatcgataggttgatgtgggtagggtggagaggagcctgttgcagtcctaaaaatggatttaatgttcttttattaatactttacctaattttccaatttttaagttggacttcgtatttgccagccatcatgctaataatcatgattttaaggaatgcagcctctaaggccttacggtaagaaaaatactagaaagaatatcttttcctttgctgtttaatgaggccatcacccttttaattcttatggattttctcactcattactagctgtggagtagcaggagattctctgcttctttgctaccttaaaaccaataatgcacattaactaacaccttaaagaagatactaacacagagattataacgatttaacacaagaataacctgttacagtaaagcagggcttatctcaggaatgcaggaatgataaaatataaggacatgcagtaatataattatgttgataatactctaacagcagaaaggcatttgctaaaattgaacatttaaaggcatttttaaaaagggattgaagatttttccatatatacatgtatatatatattttgacagcccttatcaaaaacctgtcataattatcgtcaatagcacattgctagagaataagctcaggaacaacaataacaaacatctatgtttactgtttttatatagtagcattttggaaatgtttattaatacagcaagccatgtaaaagaaaataatacacgctattattatgaaatggcaagattatacacgtagacatccaaggcattcagctaaaaataacaatctttagtcttaatgaaagtttaattaagggagcagtatatgatacgcagaagtcaatagtattctgtacattcacagaaaagaaatagaacaatttcaaaaaggtcaattcaatggaaatataatgctcttaaaaactataaagaataaacataacaaaagatgtagagaagctaaataaagacaattgcaaaattgcactggtgtactgaaaagacgacctgcataagtggaaaactgtgacatattatgggatggaaagactgaatattttctagttgttctaagttatgttttagatgacctggaattaaatccttaatcccaaatagttttttttctgaaagttgatgattttattctaaagttcaactgttaaaacaaatagttaacctttacaaatacacatttggaaataaggattttcacaaaacaatgcagagatccagaaatgtgaactacatgagcaaatatagaagatcttcaattcaaatcaccatttaaatcacaatttaaatttgtatctaaatcctttcaaaagatcattaactgtttttcagaaaattactacaaactccagcaactctacttctagatatctactcaaaagtgttgacagcaggaacttgagcagatatttgtgcaccagtgttcatagcagcgttattctcaatagccaaaaggtagaaataacccaaatgaacactgatggatgagtagatgaacaacatgtggcatgggtatgtacatacagtggaatattattcagctttaaaaatgaatgaaattttgatacatgccgaaacataaacgaatcttgaaaatagtgcgctaagtgaaataagccagacacaaaagaacaaatattgtatgcttctgcttacatgaggtacctcgagtggtcaaattcatggagacagaagtaaaatagtggctaccaggggctggagggtgaggggaatggggagttattgtttaatgggtatagcatttcagtttggggtgcgataaagttttggagatggatggtggtggtggttgcacaacaatgcgaatgtacttaatgccattgaattgtacacttagagatggttaaaatggtaattttacattatgtctattttcccacaataaaaaaagacttaaatatattaaaagtcataacaatgtattgtggcagcatgtgcacacatgtgcacacacacacagaccaggaggggaaaaatataaataaactataggaaggtgtttatactacatgtgaggtggtatatacatttatatttgatatgatatacagttgaaggtaagtacagataagttaaagatgtataacacgaaccctaaagcaatcactaaaataagaaaacagttataagttaataaatccaaaaaaggagataacaaggaataaaaaaatattctaattgcctcaattaaaatttagagttgttagaatcgataaaaattgaagatcctataagaaacatactgtaagtacaaagacacaaataggttcacagtaaaagaatgggaaaatataccatgataacactaatcaaataaagcctagtagctatattaagataaaatatttcagagaaaagaatattactagaaaaagatgattctttcataatgataacagggtcaattcatcaagagaacataattattctcaacttttagacacagatggcaaataagcagatgaaaagatgctcaacatcattagttattaggagaaatgcaaactaaagccacaatgagataccattacgcattcattagaatatggcaaaaatcagaaagactgagcacaccaagtgttagtgaagatgtggaagaactaaaactctccttcaccgctggtaggaatgtaaaatgagacaaccattgtgggaaacaatttggcagtttcttaaaaagtcaaatacctactgacaatacaattcagccatgccacttttagatatttacctaagagaaaagaaagcatacattcatagaaagacatgcacctggatattcccaacagcttaatttgtagtagccaacaactttaaataaatcaaatgtccatcgataactgaatggataaacaaacaggggtataatcatccaagggaattctactgagcaataaaataaatgaactattgatatgtaccacatgatggataaatcccaaaataattacgctgagtaacataagccccaccaaaaaggaatattctatgattccatttatccagaactctaacaaaatgccatctaatctagagtggctgctggttggctggggacaggagaaagaggctgggaagggaagagtgacaaggaggagagaattaaagaaggtacagggaaactttgggggagtggtgtatatatttattcaatatatattcattttgattataatggtggtacatttaaagtatgcttgatttattgtatgccagttatacctcaataaagctattaaaatgtatataacattgtatataaatttaaatataaatgaaaagtcgttttacctttttaagatggcaaaagaaggacatataataataataatagtagtgataattcgttagtaaatggacaataaaatgaacatatatcacactatgaatgaagagtttcgcataaataaacttctaatataaataaaggaacaaaatctaactaataaagggaagaaattgaattgtgttgatcatttatcaaaaccttcacagaagatgctgactttcaagcattggagagatagcaatagtcataaagaaaaagatacataattttgtgtatactctataagaggaaaagaatgccaaaaagccatctgggaaaatatttgcagcaaaaatgtgtgcgggtgagtatctctataaagtgtccaaacaaatggaccaattctaagatcaataaataaacaagaaaaagatgtgaacagacaattcacaaaagaggaaattcaacaagtaaatttattctcaaaaagtggtaatgttttttacccccttaataaagccttaaaagcaaagctattgaatggtgataagaatactttgaatctgatactcctttttattactgctactttgaatattagcaaaaactttacagaaagtaacagcgctggttttttagaaatgtagaactattcacatactttgctatagcaattttccttctgggactttagcctaaggaagtaatccaaatgctgaaacagtcttatgcatttacatatttttcaaataacaatgaaaattaaaaacagttcaaatagctaaaataggagagtagctaattaaattggggtataactgctcaatggaatattttaaagccattaaatataacaaagacactacatagcaatatgggaaaggcataaaatataatgctaggtttcagagcaatatattacattttatgaattctatggttacaacaatgtaaatatttttatgcaccaaacatgaaaggtaaatagagacactccttgacttaggacagtgttacattctgataaacccatcattagtctaaaatatcataagtcaaaaacgggtatttttggtatctgagatgtgaaaatacaaaacacaatatgcaaaaatgctggcaacacagaacactgtagagtattggttgtttatcctgatcacatggctgactggctgtggcttgttgctactgcccaacatggaaaaagagtatcgtactatgtattgctagcctgagaaaagatgaaaattcaaaatatggtttctactgaatgcatatcagtttcccaccattgtaaagctgaataatcttatgttgaaccatcgttaagtcagggaccatttgtaaatatggtgggtgatttatatgcatatttttaatgttcgcatattttcatatataaaaaattaaaaacagttcatgacaaaccatcttacagtaagtgaaatatcaacgccaagggtctttgaaaaacctttatgagtgagcagtaaaataaacatgagagtgttcagtgtgcaaggtgtgcatttttgggttaattttgcagaacttgttttcttcttgggtacactgatctctaaaggcccttctattaaacaatctcagattttattattcttggtgctccatcagtactaacaagtgaagctaggttttgaatgattttctttgtctatttgtggactacaaaatgctaaaccaatcagtttatacaaactgatccaactgatcagttcaatgaaaaaagtcaaagtgccaatcgtgcattatattgcttcaaggtagctaaatggatcttggttctttaagggattctttcacattttgattagccatgaggtgaggtacagacactgatgacaatctggctgttcctaaaaggttaaaaatgaacttgtagagacctcagagccacccttcattgcaaatcacactgattactaattctattaaaactctggaagtctcagtggaaagcactataagatcttggcttaagtatacctcttattatccttctaagtggcttttcttgatcatcctttccaaaacagccaattccttgctgtaattccctttttttttcattttttatcatttttttcacagtacttattacgatctgaaattatcttattaatttgttcactcttttactcatctttactcacaagatcttgtatgcctttttgactgaaatatcacctgggtttacaacactgtatgatacatagaaaatgtttaatagttgttgaacgaataaatgattcaaagaatgaatctgataccaataatggtaaggaactagccataacagtgccaaagctatcatgcaggacaagattggggttagggaagactcgctcaagaccagagttgggaccaaagaggtcagcccaatgagatgaaagaatatcagttgtcattgtagaaaatggttggcaccagagcattcaacatgatagtctcatgtataatggaaaatctgtactattctgtgatcagggagtagggggagatggtgtaaggcaatttgatcatcacaactcataggctcattctgaaagatctcagaaaccaccaaatatgtagaggtaggcgagggttggcatatcccctgcaacttggtaataaaaacaagtctcagatcaaattctgctatacacacaagcaggcaagaagagccatgtgattccaaaccaaagaaatcctagaattctgtcttttctggtgcttcacaaggaattttcataaaatgtttatctgaggcaaatgtagtagtattgtagtgatgggatttcacaaaccatccactatagaggtgatcaaaaatatttcagaacaactgctgggctctgggtttagggttaaacataatgtgccaaaactaatggtaaatacagacaacttgcttgattttcataccctgtttattcaaagatgggtgatttcttgaaaatattttagccaataaatacatcttgaatataactaatttcacctatacaatctcatttctgacatatcttaccctaactagcaagccataaattttgtcaatgaaactttacttctactattaattatgctaattagagaaatatctagtgttgatgggagagaaagaaagtagagacatttgtaacagtcatctctggagtgtcttttctttccttttttttttattttttttgagacagggtctgactctgctgcccaggctggagcacaatggtgtgatcttggctcactgcaacctgtgtctcctaggctcaagccatcctacctcccaagtagttggggctataggtgtgtaccaccatacctgttttttgtttgtttgttttgttttgtttttttggagagataaggttttgcaatgttggccaggctggtctcaaatcctgagctcactcaatccacctgcctcagcctcccaaaggacagggattacaagtgtgagccaccatgcccagctacgtctttttttttgttgttacctcctcattcctgggatatggattcctgattaggatcactgattgttccttctagtaaaactaatactgtattatacagtccattctgaaatattttaaagaagattacagacatctgaagagatatctgcatttctacatttatcacagcactattcacaaaagccaagatatgtaaacaacctaagtgcccatccctggatgaatggataaagaaaatatggtatatagacacagtggaatactattcagccataaaaaaggaagcaatcctgtcatttgcaataagagggatgagcctcgaggatattatgttaaatgaagtaagccagacacagaaagacaaacaccacatgatctcactcatatatggaatctaaaaaagttgatcttatagaagtagaaagcagaatggtggttaggggagatgttggtcaaagcatacaaaatttcagtcaaataggaggaataaattcaagaaatctattgtgcaacatggtgactaaatttaacaatatattattttcttgaaaaatgctaagagggtgaatgtaaagtgttcttaccacagaataactacatgaagtaatgcacatgctaattagttagagtcaatcatttcacaacgtatatatacttcaaaatgtcacactgatatggtaaatacacaatattttatctgtcaattaaaaataaatttagaaaacagaaaaagttacagacattattaataatatctctgttcataacgaagacggccttagccaggagctagaggtataatgaggaggcatgctgggcaaaatattgaaagatttgaggtcaccacaaccaaatagagatccaaggtagggaacaatctcatgtcagggcagaaagccagccaggcaactcagcagtccgtggaagaggcactaatgcgagcaggacctcccttggaaagatgggagagagacattaaattaggggcagcatggataaggacttgtcctctggaaccccaaatcttcactctgatcttggcaatggggagcctgaagagctctggaagtcaggaactgtgtgaaatcatgatttgattatcagccccactgctttatgggggaagtgaggagaagtgataagggttaaagtttcatgagcttttatgtatgtgtaaccacaaggggaaaagccattacaaaaggctaacatctatcagaggtgtagagaaaaggatggactttatgtatctgaatctcatctagcaaaacagcttgtcctcttcctttaaagtccacacctcaacactttgtgtcttaaaaacagacccatagccatagattcaagtgtgagccttttatttaggttgtggggaagtaaaagcaaaaagggaatccagccaataaagactgtgttgttattactgtggtcaactggagcttaattccactggggacccgagggactcagagtaggacaatagttatcccacctgagggacaagggcactaaggtatttataccagcttccatcagtcatcggtcaaaggctgttctcatggggaggcatttatttcctggcattcctggcctcttacttgtgtaggggaatagaagcagtgaggatcctaaggctgaagaaagcccaaaggcaaagagaggcagatgctggagtgagtagggtactgaaatagtaaggcctgaggggataccaatggggaggaggtgtggggatctgctatgcttgataagtaacagttgcaattaactctacataatagggtgtctgaagttagatgaagggggaatccgggttttgtgcaccctttcttgtttcagctgccttaactattactgtggtctttctccttcgtggcaaagaacgaggaggtagagagtcaaaattttcttctccaaaatgatttttgtagtttccagagtctgagcaatatatccttggttgttaccagaagtaaacattgaaactgtacccaaagactgcagcactatttgtcttcattacctgtgggggtatagtgtgagtggaattaattcaagtttgaacatatgaggcactcagagagtcacctcccaccagccagaggagggagagtcttctgttcagctcaaagctcatactgttctccctcctcttggatgactccggagaatgaatattttcaaaggcagtataggggcttatggaaagaaaaatgcttttaacagcataattaaattaaaaaacaaaacaaaactcctggcatccgtgccctcagacatcatcaaacttctatgataaacgcatcaagcacagcctttcacatgagagtgcttgtggttctggcattcttccctccttgaaactagagagaaccatatctatgcccaggtcatcgaataattgattttgccctgaccacaaaaagtgagaaagagccagatgtctgagagaagccacaaaggcttgaatttcaggtgaagtcctttctcccattgaatgatgcctcattatgattccttaaactgcccattttctggacaaatgtatgaagcctagaaaacactttcaatctgtaattataggggactagttcttgccaaatgggatatgataagtcccttttgctgggactccaaaagtttaatctagttagaagaggagaaagtaacccttgatgatttgaagcctgagttttgaagttgattttttgccttttataaaagaaacttttgtcttaaagactacccagtaaaatctttagaagggctcagaagtagggtttcttttgaatgtgtttgtctacacatttccatttacccctttccagttaaaaatcactagagagaagaacatcataactataaatggcagtgatgatccgtaaatacaaatgatgtgttttcttatgtattaataactgaaaatatttttacagttatcactgaaattcttctttcagatctagaggtcagagtttatctgctattgctcctgatgtaatccatctctgtagagaaggagctggtcttttcataagatctttggtttgaaattataacaagacgacttgctgttttgaagaatagtcactgatgaagaaaaattattggggattggatagtttcatcaacctgggtggtaatgctgagatggggaaataatacaagatatatttcactcaaaatggcctctgataatgttcaacaaaggagtatctagctgtctttctgataaagaagctgaggatttaacaatgttttaagtttttatgtggcctttgttggatgtgcttatgaatatacagaaacaaatggatttgattcaattgagaaggtggctcaacctggccttggagaagttacttgataactgaggataagtttgctaatctgtaaaatgatggcttctctgaagtcttttccttaaatgcagccaatgttctgtctatattatgtacctttgcgcatatctcatgttgagtaaagtagtcccaggggaaagggggactgcgagaaagaaaaggaaagtgaaagtcaggaatatttaatccttctggaaagagttttattagctcaattttgatacacagtttaaaaaataaagaaggctggtctactttattatttcttttacacctaagaaggttgtaggaacactgtttctcaggctcataaaggaaaatgaagagaaaaatgtctctaatgctgtcctatgttcctaaactgctgaaacatttcctctaggaatccagagcagcataagaatggcaggtggagaggaagatttatttggagtgggaccaatgttgctagagggactaggcttgcagggacatacatcttctttccattatttcctcaaaaaaatggtgccggacattgaagacaaattaccaaagcactgcatcagcatggttgatccagctgatcggaccaacacatctttcttttaatagactatgcaggttgttttggtttcaggacttctgactaaatggttttctttcttataactctatggcagaaggttctgtgcaaaggatcttaatcttaatgtgtgtacataagcacacatttctctttaacatggatttcttatttacaagtcatattttggtggataaaagctaatagattgttttgaaaaatcacataaatggaattgggcaccgttgagagttattacttcaacaacaaatcgacagtcaaacttatggatattttcagaacccccagtgaaatgtaatttaaaatattgggtcctcaatgaagaccaacttatttaatattaaaactcaatacaactgagtgtggtggctcacgcctgtaatcccagagctctgggaggctgaggtggaaggatcactcgaggctagtagttcaagaccacctgggcaacatagcaagacccagtctctgcaaagaataaaaacattagccaggcacggcctgttgtcccagctccttgggaggctgaggtggaagcattgcttcagccaaagaattcaaagctccattgagctatgattgcaccactgcactccagccagagaaacagagcaagacctcaactcttaaaaaaaaacaaacaaaacaaccacagttgaaaatagcagcccattaaggttttaaaactgccacccttgattcttttaaaattgttcttttttcagtatgttagccatataatatgcaaataatctcatcattaatattcactcaatttgatgcccccaatatagaccaatgctagcaaaggaatgtagaatcgaaccctctctgaattaagaaaactgttcataatgcgtctagaaagctacattgcagataaaatgtaatctcacatgaactttgtatatacaggaaaattcattatattagctccagaaaggaaggcaaaagggcacgtttctctacattgatggaaatcatagatttttttaaactgaggctttaagagtcagagatggatggtatcccactttctaaatgtctatacattggagacaggattgatagtcttattagtctgtcctttgtgtatttaaaacatctcaagtctctggtgctaaaagatttatacagcattttatatttataactcatttctattcattactcttcaggatggcttcaagaaggctgctctgatactggccccaggtttcagagaggacaacagacactgaaaaattatgtgatggaatggaagctaggaagtggcagtggtaggattataagtttttattgtctcttacactatatgatcagaaatgaaagggaaactttggaaatttagaagacttttctcagattagataaatcccactaaaccttggtagttagtaccttacccactatggagaaagatccttagaagtctacagttgcccctagaggtcttctgggggctactaatcttgtgttgaggctactaaattgggggagtaggtagaggtagatggttgttttatcagccctgaaccttctctccatgtccttattctctgacactatttaaaatggaaagcagaggacaacagagtaatacaatattaatagttattcatcaggaaataaaaggtaactgggtgatttttacccactctcaagtaagaagtaacactgattactgcaatttgctatgctagaaattgcacagaaaataacttaaccatcacttttttttagtgaaggagtggctttactcctccatgcatgtactctgggagcagcacaccatggaattgtcttggcattgtttctataagtattttttccgaggatactgatctttttttttttttaattttcaactgtggtaaaatacacataacatcaaatttactattgtaacctttttttacatgtacagttcaatagtgttaaatatattcgcatcgttgtgtaaccaatctccagaactcgtctcatcttgtaaaacaaaaatcctgtatacatcaaacaacatctccccatttccccctaccccccagcctctggcaactatgttctatttcctgacttcatgaattttactactctacatacttcatataagtgggataatacaatattagcatttctgtgactagctcatttcccttagcgtaatgtcttcaaggtttatccatgcttccatgctatagaatgtcgcagaacttcatttttaaggctgaataatattgcattgaagtgaaattgctggatcatttggtaattctatgtttaatttttttgaggtacttccatactgttttccatagcagctacatcattttgctttcctaccaacagtatgcaacgattctaatttattcacttctttgctatttactttttaatagtagccatcctaatgggtatgttgtggtattcactgttgtatttttgtgattagtgatgttaagcgttttctcatgtgtctgtttgccatgtgtatatcttttgatttttttgagaaatgtctattcaagttctttgtccattagaaaacttgggttgtttggggggttttgtcattgttgacttgagttttgtgaagttttgtggtaaaagaatcacatggtcaaagagtttgggaaaccatgattgttttatcaccttcctgaagatctgcagtgcacctatatcatattaaatgctctgagtactattactgtaaagaaaattgctaactctattaaaaaaagggatttaaaaatatgtaactactgtgaaaccgttttgcactgaacacttgttcccatcttgagccagtgggcaaccatcaaatgcagtttgtgaaaacctcttctaagtgtttgtttgttttgttttgtttttaaacagtgtcgcgattcctcaaggatctagaaccagaaataccatatgacccagcaatcccattactgggtatatacccaaaggattataaatcattctactataaagacacatgcacacgtatgtttactgtggcactattcacaatgacaaagacttggaatcaactcaaatgcccatcaatgacagactggataaagaaaatgtggcacatatacaccattgaatactatgcagccataaaaaggatgagttcacgtcctttgcagggacatggatgaagctggaagccatcattctcagcaaactaacacaagaacagaaaatcaaacaatgcgtgttctcactcataaatgggagttgaacgatgagaacacatggacacagggaggggaacatcacacaccggggcctgtcaggggatgggggactagtggagggatagcattaggagaaatacctaatgtaggtgatgggttgatgggtgcagcaaactgccatggcacgtgtatacctatgtaacaaaactgcaagttctgcacatgtaccccagaacttaaagtataataaaaagaaaacaatagttcataaacatttccacttgagaaggaacggctgttgtagcaagctttatcatgctgtgtctcccactcagacaagcttttctctttcattgctttgcagttaatttatttagtgctgactcaatactagggctatgtaaaaaattaaattatagtcacatcttttaatagtttctatggggaggtaaataattataatagagtttggtgaatatgctgtgataatcataaggcatattatcttagattattttggttacaagtaacagaaccaaatcaaaccaggtgtaagtaaaatggaagaatatgttttaagggtacagaggtgtttcctggagctcaagggtaggaatgtagtcagctttggaaagacctggacagaaggcagagcttcctatttctcctttcttttctcggaaggtctgtctctattttccattctgcagaatattattttcaatatgactgccacaaggctctgtagtttatatattatagctgtatatgctggcagagaatattttgctgtttgctccaattctaaaatcccaagaaagagagtaactgactcagcatttgtaaagtatctatacatggcttagccaactgtagccagggagatggagtcatgtattaaaacatggctgctatggatccaacatcctgtccaacttcatctcttgtcacttcctccagacatcccatgtttcattgacaccaataatgattgtctatggaggaaactaatacaaattaatatgaaagtttactaatgataaaaataattctagatatacatttaaaatcttacctacataccagcattaacaattacaaaaagtagtgggaaggcagagctcattcacattaataataaaaagacataatttaaataaagattattctttgttttttgagacggaatttcgctcttgttgcccaggctggagtgcaatggcacgatctcagctcatggcaacctccacctcccaggttcaagtgattctcctgcctcagcctcctgagtaactaggattacaggcatgcgccaccacgtccagctaattttgtatttttagtagagacagggtttctccatgttggtcaggctggtgtcaaactcctgatgtcgcctgcccacctcggcctcccaaagtgctgggattacaggcgtgagctaccacgtgtggcccataaagattattcttaacaagaatgtacaagactgaaaatttcataatttaaatgataagccattgaaataaaagggcaaaatatctaattttggtctgctagacactgaattctgaaactcagttactgctatcctgtgtgcctctattaccctaacttggataaaaagtgacagtagtcattgaagtgaaccacccagcctcagcgagacagacagcagatattcatttgctgacttacactgtcatctacctttatataggttagtaactagaactaattgttgaggtaatgaataagtaagagaggatttaggcaatctcagcaaagatagattagctcccagaagccagagaacaataaatcaaagtgagatccaagtctaaaaagctggcagacagcaaactcattgcatccataaaatattttagttaaatactattcacctgaggagatcagttctgtctgttcctaatttgcaatttgaggagaaatttgtagattcagaatgggaaatgtttgggaatactgttttacatatttcatggggcagcatcttcaccttatgggtttttagaaaatgtattccatgaataatttcctgaaaatattgcatttttactgtaggcattagacagttttaacttaggtaatgaaaattctaaattggttaactcattctttaaacctgttatgttatcatagtcactaaaatgtatgcttttcactcccataactcttctacttcaaacagtttaaattcatgaggttagatactgctgttttcttcttttatcctgtgaagctttaattctttaacaccgtgaaggcctcttattttgttaggtgctgatttatttaaggatacacttagctgaatcccaagtgcttaagattttattacatttcttacttcaggcattggaaaattatcacttttgaattgtaatgaagagaaatagctcattgtttgctttatattatttagacccaaatattattctttggcaaagtagagaataaatgtaatttcaagagaaaatgaagtaacgttttcctctttccatttgaaattgggtacatatagtaaattctgtgactaagactgtaacagcaaaagtgtatacagtgattgaaactttcttatttgatagttttaagagagaagcatatttgcagcatcatcaaatctcttcaagacatttttaacatgcagactggttcattcacttattgatccattcaataaattagactcaactgatttctggctttcaggatttttcatctatgctttaaaccagagatcagcaaagtatgcctctcaggccaaatccagccaattctctgtttttgtcaatagagttctattagaacatcaccaccacagtcatttatttacatattatctctggttgctttggcactacaacagagttgagcagttgcaaaatagactatatgactctgaatacaaatctgaaaacatttactatatagccatttacagaaaaactatgtggagaattctagtttcagatctaaaatgtaaaaattttggaagttgtcacacctgtccttacaactcctgtccttttagctgagtatactgaaagtcaacaatttttcatgaacccgtcagataaccgaggtcaaaatgcaaactaccatttcaaaatcttgagagacaggtgaatggaaatagtcacagtcaagatttctttacctacagcagaagccaatgggacattaactggtagtagaaacagctaaatggtaatcttgactaattgctggagccttagtatgaactagcatgacagtaagaaaatacttggattttaggggacccccacattttcacgaattttacttccagaaattctcccagtgtgaagagctgagaaacatgcccttgaggctccggcacggggagaggaagagtaaccttaattaaatatgcccagagtgttcttcacaacaaagattgactgtgcaggagaaaagactgtaccagagccctgacccaaaaaggggaaggccattctcccactccagctatctctagccttcctttctcacccaagacaagtaagttaagaaatgcttttgaaagtcacaacctagggacgtaggttcagtaaaaattgaaatttaatcataaggcaatagaatgcttccctttccccaccccttaccaccactcacaacaggaattcagtgtaacaacagtgggtcacagctgaaagagctgcaaggcacagactcgctctgagaaggagtaggtagggaagcccaaagtcaacaggagagacaaaaacaaggacacaagaggattttgaatcatcaggcacatacagctgcagtaaatgttaagcacagccccactcctagcgagattaacataaaacattgaaccaaagacctatttctctcagtttctattattcaatagattatatacaatttttaataaaaaattagaaggcattctcaaaagcaagaaaaaaattatctgaagaatataggcaaatactagaactacatccagatatgacatagatgttggaattatcagacaggggatttaaaacaactagaatatatgaagtgttttaatgaaaaaagtagacaacatgcaaaaacatgtgtaacatgagcaaagagctggaaactctacgaaagaataaatggaaaataatagaaataaaaaaaagaaagaggactgtgctgggaataaagaaagtctttctttgacatggctgagtagacaatcaatgagcttgaagataagtcaatagaaatttcctaaatggaaattcaaagagaaaacaaatgaaaaaacataaaagaatattcaagaattgtgagacgatttaagtgtgtagtatatgtgtaattaagaaactaagatgacaagatagaacagagaaaaagaaatatttcaagtaataaggccaagaactttccaaaattaatggcagaaaccaaatcatggatccagggagctcagagaacaccaagcaggacgaataccaaaaatattacctcattatgtcacactcaaactgcagaaaaccaaagaaattaaaaaaaaaaaacaaagggaaaatacaccttatctacagaggaaacaaagatgagaattacagcatacttcttgtcataaactgtgcaatcgagaaaagagtagagtaaaatatttaaaatgttaagagaaagaacatcaaaccagtatttaaatccagtaaaattatccttcaaagtgaaagagaaataaagactttcttagacaatgattcagagggttcatcaccagcagacctgtcttgcaagaaatgttaaaacgagttcaccagggagaaggaaaatgatagagatcagaaacttgggtatttgtaaggaaaggaagagggtcagggaaggaacagataaaagcaaaacaaaatattttattgttcttagtcactattgaactgaaatgtaactctgtttaatgtaataatagtaacaatgtgttaggtgattaaagcacgtatataagtcaactgaatgacagcaacgttataagagatgggagggaagaattgagaaaactcagttataacataattgtactacacctggagcagtatagtgttttaggaaagtggattcatattaattagatatatatattattcacacacacatatataaaactctagaatgaccactaaaaaattataaaaaataagtataatttatgtgttaagaatgtagataaaatggaattttatcttcaccttattacttgaaatatttcttctgctctgttctttcttctcatgctcagttaaaaccagggaaagaagaataagaggcaaaaaaagaaaaaaaacaaatgtaatcaatagaaagcagttacaaacatggtagatattaattgtgtaatgatgtatcattgatatattatgcaaatgagataaatacacaaattaaaggaaattgtcaaaacagatattgttaaaagactcaactatatgttgtctacaagaacctcactttaaatgtagacacatagattaaaaataacgggatggagaaagatatatcatgctaacactaattttaataagctggagtggctacattaacttcagataaagccaacttcagtataaataattatcaggagtaaagagaaccactaaaggagtaaattctccctgaagatgtagtaacactaaacacatgtgcacctagcaagagactgtagaaatacacgtggcaaaaactaaaaaagaaatagaggaatccaatttatagttggagagctcaacaccttcccgtcagaaattgctaagtcaagcaggcagaaaataggtaaggataggttgatgtaaagaacacgatcaatcaacttgatcaaattggtatttataaaatactcaacagcagcagaacacatatttttataaagccttaccgaaacagaccacatctgagaccataaaacacacattaacaaacttaaaattgagatcacattctaggttgtattacacagaccatgaactgaactagaaatcaatagcaaaaagatagctgtaaaatcttcaactatcagaaaactaaagacatttctcaatactacataggtgaaagaagacttgaaagaaattaaaaactactttgaactaaaaaatgaaaatacatcttaccaaaatttgtgggatgaaacaaaagcagtgctcagagagaaatttatggcactaattgaatacattttaaaaaatgaatatttaaaatcaacaatttaagtaagcttttaagaaattggagaaagaagagcaatttaagccagaagcaagcagaggaaaataataaaaattaaagcagaaataacttaaattgaaaaacaggcaaacaatagagaatatcaaggaaaccaaaagctaattctttgaaaagatgaaaatgttgataaatctcttcaggctaaccaagaaaaaaagtgagaactcaataaaccgtcaatgttataaatgaatgaagaatcatcattactgatactatggacaagaaagggataataaaggcagctgggtgcggtggctcactcctgccaaggcaagaagaggaggctagaatgattttcatggtaatagagctagaagcataagtataaactcatgttcaggctaatatagatatataggattacatatacaagttatagatatgtgtataatcccagattaggatacacacataatatttccttactcttccagctatgagggcatacaagcaatgatacctcagtagcactaacatccagctcttggtttctaatacattgtctaataaaaggaaccagagcatcttggagaaatggctgattctagctaggactgggttaggaagtaaatattatgagactggagcatcttatagctccagaaagaaagcaagtattcaagaaaaaaaaaacaacccacaagaattgaatatatcaaagggacataggagcctactgaaagagcttccaatggccaagaccggaacaatttcagcaaatgaataaataataaagtagtattagatataatataaacatgcatgagtccatactgatataaataaataatggagtaagtggagaagagacaaagagaagtaactaagtggagaagaattccaaataatttatctagatattctgccctcaatttatgtagcttacctcccactccataggtgtgggctacaaatattgacttccttccaaaaatcacattatagaaatagggaaaaaagggtaactttagagtggataaacctaacaaacgctgccttagccaggtaataaagaatcaacattaaaaatgagtcatattaatagtatatactcatgatatgatatggtgaaaatggtactttacctctgtggtcttcttccccaaaacctgcaaccccagtcaaataataagaaaacattaaacaaactcaaattgagggacattatacaaaatacctggtcagtaattgtcaatattctcaaggtcatcaaaaacatgagaatgtgagaaactgtcacaaaaaagagaatcttaaggagataaatgccaactaaatgtaatgtggtatcctggataggatcctggagccaaaaagagacagtaggcacaaactaaaaaaattgaatgaatctaggcacagtggctcccatctataatcccagctttttgggaggacgagatgggaggatcacttgagcccaggagttcaagaaccagcgcctgggcaacatagtgagaccctgtctctacaaaaaaataaaaataaaaactaaaaaaatgataaataattgaatgaactatggacttcagtttataataatgcatcaatattggttcaaaattgtaacaaatgtaccacagtaacataatatgttaataacaggggaaactgggtgcctaatatatagaaactttctgtattctcttcacaatttctctgtaaacatataaagactgttctaaaatagccaccatgcctggcctaaaataaaaaagttaagaaaaattttgctgaccctactgtaagtgaaagaaaaatggaagtgattggtttgcacattttttgtggtatgatttaaaaaatgaatttgttgaagaaagataacaagatggtttcagattattctcaacaactgaagagtcagtttaaaccccgattcctatgtgtggaaaattaactctatttctttcagtgtgggaagtagcatattgcatgacatagaacattggaaataaatatacaaaatattgggatgttcaacccaaaacagttacttgaaaatatttgataaggattcattatgtatactttacttttaaaattgcaatttaagttcccaatttttactatatttaaaaaaagaagtatttgtttctagaaatgaattctgatcaagaaatggaattaaatgtgaataaaatgcctttctgataaaggacaaaaattgaaaaaacatactattgcattaggtaaacgcaatagaaaattcattgctttttttgaagcaaccctacagagttaattcctccatggtgctgaaggcttttgctttgaaattcattttattgacctaaagcttaaactgcagggtggctccagaataactgacaggagggagagaacatcaggctagcattgtcacatgtgccctcattcagtccctcgttaaaagatgcattatgtaaatgtatcccccactgaattttgctgcatattttttgtccctggtaaagtattacctatgtttgtcaaggaggagggggaaaacccactctttcaatggttcagtgattatgcccccacactttaatttctgcttgaaattcaagcccacataaaaggtttcaaaacctaaaggtagttttactttgttcctgacttatgtgtataacgtgggttaaggaaaaataaagcatatctatagaagcagataatagatgtaattagactctgaaacaagtttctttagtaaaattattttccaaagttactttgtagtgcaatgatgtagctacaaaaccaatctgcattacatgagccaaagaagtgatcaattattcatccagttatgtatatgtcaaccaaaaaaacagacagacacacctcgttttactgcacttcactttattgtactttgtagatattgcatgttacacaaattgaaggtctgtgacaaccctgtgtcaagcaagtttattggcaccatttttccaataacatgtactcacttcatgtctctgtgtcacattttggtaattctcataatatttcaaactttttcattatatctattacgatgatctgtaataagtgatgtttgatgttactattgtaattgttttggggtaccatgaactgcacccatataagatggcaaacttaatcaatgtcatatatgttctctctgctccaccactctttgtctctctccctctcctcaggcctctctattcccggagataaagcaacattgaaattagagcaattaataaccctacaacaacctctaaatgttcaagtgaaaggaagagtcacgtctctcactttaaataaaaaactagaaatgattaagcttcatgaggaaggcaggttgaaagccgaggaaggctgaaagctgggattcttgtgccaaacagtttgccaagttatgaatgcaaaggaaaagttcttgaaggaaattgaaagtgccacttcagggaacacaccagtgataagaaagcaaagcagcctaactgctaatatggagaaattgtgagtggtctgcatagatcaaaccagccacaacacttccttaagccaaagcctaatccagagcaaggccctaactctcttcaattcattgaaggctcagagaggtgaggaggcttcaggagaagagttggaagtcagtacaggtttgttcgcgacgtttaaggaaaggagccctctccataacatagaagtgcaaggtgaggcagcacgtgctgttgtagaagctgcagcaagttatccagaagatctagctgagatcattggtgaaggtggctacactaaacaacagattttcaatggagatgaaacagacttatataagaagatgccatctaagactttcatagagaagttgagaatgcctggtttcaaagcttcagaggacaggctgactcttttgtaagagtccaaggcagctggtaactttaagttgaagccaatgctcattgaccattccaaaattctacagctcttaagaattatgctaactccactgtctgtgctctgtaaatggaagaaaaaagcccagatgatagcctatctgtttatggcatgatttactgagtattttaagcccactgttgagacttactgctctgggaaaaagaaaaaaaaagattcctttcaaaatgtcactgctcactggcaatgcatttgatcacccaagaactctgatggagatgtacaaggagattaatgatgttttcacatctgctaatgcaacatctattctgcagcacatggatcaagaagtaacttcgactttcaagtcttatttaataaatatattttgtaaagctatagctgccataaatagtgatttctctgatggatctgggcaaagcaaattgaaaatcttctggaaaagattcaccattccgggtgccgtaaagaacattcatgattcatgggagaaggacaaagtatcactattaacaggagtttggaagaagttgattccagccctcatggatgactttgaggggttgaagacttcagtggaggaagtcactgcagatgtgatggaaatagcaagaggtggagcctgaagatgtggctgaaatgctgcaacctcatgaaagaagttgaacagatgaggaattgcttcttatggatgagcaaagaaagtgatttattgagaaagaatctactcctggtgaagatgctgtgaatattgttgaaatgaaaacaaaggatttataatattacattaacttagttgataaggcagccacaaggttggagagaactataattttgaaagaagttctactgtgggtaaaatgctatcaaacagcatcatatacagggaaatattttatgaaagagtcaatcaatgtgacacacttaactgttgtcttattttaagaaattcccacagcttccccaactttcagcaaccaccacccttatgagtcaacagtcatcaacactgaggcaagatccacaaccgccaaaaagattaccacttgctgaaggctcagatgattgtattttttttagcaataaagtatttttaaattaaggtttgtacatttttaatgacataatgctattgcacacttaacactgtagtatactgtaaacataacttttatatgcactgggaaaccaagaactttgtgtgacttatttgctatatttgttttactgcagtggggaacctaacctacaatatttccaagatatgcctgtacaaatgatagatgcagatatgtgaagagttgaaaataccaactcttagaaacagaaaatgtcaagttatccgttaatgagaagctaaattactgctcagttaaacagtggaaatacagggaagtgtgatggtcttggatcatggatgaaatggtcaaggtatttctcaatgaaataacttgttctttttaatatttcttataaaccatgtaagaaagtactactgccggaaagaaacaaaaacagtagtggatttttatttacataacagaattatgaataaataataaatgcctatggtttaattttgagctgatgtgttacccatactttagtatcaggttgtactaatgtgagactctgagaatttggttctgtattttaaggccataaggaaaacctgattaatacagagcaacacataaaactagctggaaagaaaatgcactatatcctcaggttttagagatgaactatctcatcgttctgtatttgtggtttttctagcattaaggaaaacaaaatagaatcttcttttatagtcttaaactctctcatattagctcttttagtattgatatgtttgtagagaaagtgacttgagtaaaataaacttgatggcccttgacctcaaatccacttttaacctgtgttcttggccaggtgtggtggctcatgcctgtaataccggcactttgggaggccgagatggaaggatcgcttgagcccgggagttcgagaccagcctgggcaacatagtgagacccgtctgttcaaaaatgtaaaaataagccaggtgtggtggtgcgtgcctgtagtcccagctactcaggaagctgaggcgggagggtcacttgaggcagggaggtcgagattccagtgagccatgattgcactactgcactccagcctgggtgacagagcaagacctgtctcaaaacaaacaaataaacaaaataacctgtgttctccagactcctgagctatcctgcaagccttgttctttcaaacttgcacatggtccatgtaaaaaaggtaggtttataaaactaaatcagaattgtgttattctaggacacacacatttttggggggaatactagaaaatttaaatctggataaagcttttttcagtttcatttctatttgagcagtaaaataacttgaaatgcttttttatagcaaaggagtgattaaacctctttatctttgcatttaaaaaaggggatttgattaaatgtaggtatatgtttagtgtcaaaacttagtcatgcaagaagggaaggacttattaaccagacataatcgattcaggtgttagtgtcacatagctgtggagtcgagccattatgtcttccctgggcaagcttcttccctcatcactcagctcactagtatgcagctggaaaataccagcacagagtatgccaaggcagacaaacaaatgactcaagggagatttaaactccatgactgtacatattcccataaagtctaaaaaacataagtactcacagcagggtaaagccctacagttttctttcagtgaaacaatccacattatccctgtggttagaatgatgagaaaatgaatttgaaaatatctgcaggacggtgctgatatctttggtcaagaaataatagcaggaacccctttcattttcccaaacctatagcttgttcctgatacaaaatggcctagtgaggttgtgatagtaacatcagacttgggaagtctgggtcctcagcttatgtccacatttcttaatcacaactgtttctctatagtaaaaggaaagcaggagatgatggtcattataagaacatgtaaattatcaaaaccaattttgcttcatttatctgaatattttgggaaataataccatctttttatttaaaaaaaaaaaaaagaaacttcctatcattaatcatgacagttactgtgtattgagtgttaccatttgccaagttgtttactaacaggctttatgttcattattcacctaaccatcacaaaggaaggtatcatgacgggcatcttacagatgaggaaacaaaagctcacagaggttaagtttcattatcacatattttacggataaaaagtggcagaatcttactaaatcccaggtatgtgtgtctttgtctgcacacaaaacattcttcactttatagattcacctagtcacctaaattcttcacattttcccaagtacataggcatctgtgcaataatagaaagtgctttttgttctaacttagtcaagttaaaatatgcaggtctggacaacttacttgctatagcttgacagtggtagcagcacgactgaaattcagaaatactgattgaaatgactggaaataacctctggcaaagtggttcaactgacttttgtgatactatggtctcagttttgaagatcattttgcattaatcttttacaatgtaacttatgttgcttcaactaaacaatgagcacaactctaacttgtcttctattttccttctttgaaacgtttctaaatttgtttatttctctggtttacagagggaaggggataaggtatttttattaggggtcaactcagcattttacgactcagtggatgacacaaatatgaatcaataagggatgaagccctacttcgattaagaggcaaataatttccaatttaacaggaaaaaaatttggatttaattatccaagtttatgactaagttattttgatcaaatttaccaagtttgtttattctgccagcagcattattagagcagctatcagcagaaaacttgaaacaactacaaaagtagcactgagatattacaagttaatgtagtgaaattcattcattcattcaacaaatattgttgaatgccttctttgtgccagatactgttttaatgtcttttaaaatgcccagcctaggcaaatggtatgttagataatattaagagatttgttaaaaaaattataagtcaggagagagcgattatgaaggttgagggtaggagtaattttagattgagtagtgtggtagttttaaaacacgtctgcaaattctttttttctcttccttttttttattatactttaagttctagggtacatgtgcacaacatgcaggtttgttacatatgtatacatgtgccatgttggtgtgctgcacccattaactcatcatttacattaggtatttctcctaatgctcttcctcccccctccccacacaccacaacaggccctggtgtgtgaagttccccaccctgtgtccaggtgttctcattgttcaattcccacctatgagtgacaacatgcggtgtttggttttctgtccttgcgatagtttgctcagaatgatggtttccagtttcatccatgtccctacaaaggacaggaactaccatctcacaccagttagaatggcgatcattaaaaagtcaggaaacaacaggcgctggagaggatgtggagaaataggaacacttttacactgttggtgggagtgtaaactagttcaaccattgtggaagacagtgtggcgattcctcaatgacctagaactagaaataccatttgacccagcaatcccattactgggtatataccaacaggattttaaatcatgttactataaagacacatgcacacatatgtttattgtggcactgttcacaacagcaaagacttggaaccaatccaaatgtccatcaatgatagactggattaagaaaatgtggcaccatatacaccatggaatactatgcagccataaaaaatgatgaggtcgtgtcctttgtagggacatggatgaagctggaaaccatcattctcagcaaactatcgcaaagacaaaaaaccaaacaccacatgttctcactcataggtaggaattgaacaatgagaacacatggacacaggaaggggaacatcacacaccggggcctgttgtggggtggggggaggggggagggatagcattaggagatatacctaatgctacatgacgagttcatgggtgcagcacaccaacatggcacatgtatacatatgtaacaaacctgcacgttgtgcacatgtaccctaaaacttgaagtataataataataaaaaaagaaatactaagaaagaaaaaaaataaaagaaagaaaatgtggcaaatatacaccatggaatactatacagccacatctgcaaattctttgacacacctcccatggagagaagggcctatgtcccatccttgaatctggaatggtcttcatgactcacttgtaatcaatataagtcaataaacatgaagctgcatgatttttggcgtaaggtcacagaaggcaacgctgcttacaacagcaacaaggattttcccaaatgtatcctaagaggtggtagaacctaccccatccttgagaatcactggtctagaaattctattagcttgaaaatgttgcaggtcacttctttacttgagagacaaaagttggtattcacacacttgtggcaataatatgatggccacatgttcttttctattcatttttatgagttggagatcttaggagtagaggatgaggagagcctatgtacaagaggctgtggttaattttggggaagacataggatctgtattcttttaattatattttattaaatattcaggacttcttccacctgctcagaggtgtactccacttcctcgtggtttggcttattttccagacacacatgtatgccttgaaagatgtcaagtccaacgtcacttttctttccacttacagccaagaaaacagaagttgctctgtctatatcaagtatgaaaggttttaaaacaggaaactagaagcttataaaagctttggacgttcttggggagcacagttcagggaagtggccagcaaaaacttcagaatgaagcacccaagcagatggttaagaacaaacttgtaaaagatcaatttatcaatttatgcagccaacaaacatatgaaaaaaagctcatcatcatcggtcattagaaaaatgcaaatcaagaccacaatgagataccacctcacccccagttagaaaggcgatccttaaaaagtcaggaaacaactgatgccggagaggatgtggagaaataagaacgcttttacactgctggtgggattgtaaattagttcaaccattgtggaagacactgtggcgattcctcaaggatctagaaccaaaaataccatttgacccagccatcccattactgggtatatacccaaaggattataaatcattctactataaagacacatgcacacgtatgtttactggggcactattcacaatagcaaagacttggaaacaactcaaatgcccatcagtcagactggattaagaaaatgtggcacatatacaccatggaatactatgcagccacaaaaaaggatgagttcatgtcctttgcagggacatggatgaagctggaaaccatcattctcagcaaactatcacaggaacaaaaaaccaaacaccacatgttctcactcataagcgggagttgaacaatgagaacacaaggaggggaatatctcacatcagggcctgtgggtgggttgggggcaagggcagggatagcattaggagacatacctaatgtagatgatgggctgatgggtgtagcaaaccaccatggcacgtgtatacctatgtaacaaagctgcacattctgcacacgtaacccagaacttaaagtatatatataaaagaacaaacttgtaaaccgctgcaactcaaagaatctttggaagatgtcaacgaccaccttaatctacagcagtgagtagagacattttcaaggactcccctagaagctctgtgaatatagtgtttattcatacatctcccccaaatctctgaaatcttacctgggtgccacttttgggcagactcgatttaacaacccaaaacagaggcagcattttgcgaaatggagtgtccattttctcatctgcaatgctctagaagaactcagacgggagcgatgatgaagacagcttaatagatgatccagcccactttcttcatagagcattcatgatgttcaaatgagattatacatataaaatgatggaaggaagtgcaacggaatagatgttatctattaatagtactagtatattattaatggcatttctgttactgaggaggaagattgtatgatcctgttatgttgtgatttctacttctttacttggaagtagaaatgttggccccaaactcagattcattctcttttagaattacacatttctatttagcccatattgaagttgttttccagaagaggattatgaggggtgtgtgtgtgtgtgtgtgtgtgtgtgtgtgtgtgtgtgtatgaattaaatgtaattctcacaggaaattaaaataccatcattcaaaactctaagctgatatagcttaggactttgcatactaattcaaagacatgaaaacctttcaagtgtctacaaaaaagggaaccagttggaaaattataattggaaaattgtaatatcgctttactgacacagaaaatattttctagcattactttcaaactagcaaatatgtatttattatgcactactgaaactgttttatgaaattttatttttttaatttggagaaagaaagaaacacaaacaagttttactttttggttgtggggagactgtaatgatataacaaatcatttatctaaaactagacacctttttatgcttgagaatatattttatatttctccattcatataaggtaagcactaactgtggctttaattggagcttttagaatgccttagtgaatactttgtacataatttagaagtattcacatagtccagctttgcaccagaactgttccctcttggtactaacaagggcatgatctgacacttggtttggagaataagaccagaatggtcaacacattgttgccacttttggtcttttgaatcactgtgctactcttttctaagtattcaaagcaactataaaataaaataaatgaggacagtttgggatttagaggaaactcttccatttcagtatttgaaagaagagtggtatttttccttaaggcagtctcttgcagaaatgttctatgtctttaatgggtgaaaaacatggactagattttgtcagtcttcggggattaaaaaacttcaaccttcctgtcactccatctgcaccaaaatagtcttaaagattattctgtaggatggcaaaagaatcactttgatgtttcttttccaacttgaaatttatatttgatatattataaagtaaaacgtaatgcaaaatgcgcatctactaaaaaaaaaactctgaaaagtatttgaacttaacattcctcattcaagtacagaaacactgcttcaagagaactatattctaaagctgcttatgtttagttcaactgatttcacaaataatacctctttcaggttgatggttactagtagagctggaagggaatgcctgtgaaaagagatagacatgtagggagcttcacttgttttggtaatgatcagtttcttaggctgggtcatgggtgcatgtgtgatgctcatttaggtctatattcattttttttttgcatccagatgtctgatttttccagcaccatttgttgaaaaggatcttcttcctacattgaatttggttttcccattgtgtaaaataattaggcttatttgtgtggccctattttaggttctatttctataccactgatctatgtttctactcctgtcaaaaaataacgcagcattttgcttactgcagctatatggtaagccttataggaaggaagagtgattccttccacttcattcttcttttttaagagttgtttagctaatccagtgattttgtctttgtatatcaattttagaataagtttgtatatgtccacaaaaagctttgcttggattttagtaggaattgctttaaacctagagatcgatttgggggaactgacatctctgctacgttgagtcttctaatccatggatgcagtatttctaattttctcaaatttttgagaaaaaatatttacaacctaagattctatgtccagttatataatagaacaaaaagaaaattttaccacacgaaaagtctcacgacaatttatctactataccccatttctcaggaagctatttaggctatggtccaacaacatgagggaaatgaggaaacggctctcacaaaatggattattcaaatggaagtaagtaaagggaatcagaataataacgaagggatatcccagggtaatagccatgccccaggagtagagggcaaccactcctgcttgttgtcagaagacagaggtgatttctttaaaatgatttaattcttagaataatggtatcatatgaatgtattgaggtatgatttacataactgctagagagttttaggttgaataactaataatacagaaaaagcccaaagcaaacaaaaaactagaccatcattatctccaagggaaaaaaatgggcaggaaaagcatggcacattatctttttataattatgtagtgaaaaagcttttcatagttatgacggttcaaacattgaatagtgatgaaaagaaaattgaaacattttatattggaaagtaaaggaggggacaggaagtatacacgtgtagttgatacagagcatgagaatggcataccataaaatggaagaataagttaaaaaaagcaaaaccacattatttagaagtatggaggtaaccttatatcaacaagtctatcctgaaagaatcaggaaatgtgacgttccagctttgttctttttgctcaaaattgttttggcaattcagggtattttgttgttcccatatggattttagtatttttttctatttgtgtaaaaaaggtcattagaattttgatagttattgtattgaatctgtagattgtttggggtagtatggatattttaacaatattaattcttccaatccattaatacagtatgtctttccatttacttatatcttctgtttgttttatcaatgctttatagttttcgacacttgtgacaacacagatgaacctggaggacattatgccaaataatataagccagaaacagaaggagaaatactacatgatttcagttatacgagaaatctaaaattatcaaactcatagaagcagagagtagaatggtggctgccaggagctggagtagaggaaaattgagaggtattagtcaaagggtacgaagtctcggttatgcaagacgaataaattctagagatctactgtacaacgtaacacctacttaacaattctgtattgtatacttaaaaatttgctaggagggtagatcttatgctaagtgctcttatcataaaataaataaagagggtaggaggaaactttcggaggtgatagttaagtttatggtatcaaatgtggtgatggtttcgctagtgtttacttatttccaaattcatcaagttgtatacattcagtatggacagctattattttgtcaattgtacctcaacaaagtgttttttttaaaaaagaaataaagaaacagatgcatattgctctccatctcattctaaggggtaacaacattaagaagaaatgtaataatactctttacattaaagagactgaatttttcattgctactctttcagatttacttacaatttttatttgatcctaaataatactctcttgcaccatctaccttcaaaacaaaacaacgacgacaacaaaacactgaaagaatcagccagaaagagttgcatgttgcttctggaaggggaaagtagggtgatggtaagaaactatgttgcataaaaattagaatacaagcatttgactctaacatatgtgaacttatgataaatttgataaaaatttaaaagtataaaaaagtataactttttgtaatgtctcttttcttgattgctcatgtagttgagcatttatggtagtgcccacccacagtgaccctgggctaggtcatgaaactggtttttgctaatgggacaataataaacttgaaaaagcatttgtgtatttccacttctgcttttgggcaccagctgatgtttctttctttccttcacgatgttttacttttgtgtaggtcttgtgttttttttatttttttgcaagttcatatgtgtatgaactttttctatggagatattttgagaactgggtaaatgttgtgatcttctagggatgatttaaaaaatttttattttgccaagcactcatgagcattaccatccaagacaatgctaatataattctttggcttgaggctttttggaccaccccaaaaatataaactaaggccccaaacacatattaggggagatacagacgcaaggtttagagacagaatagtttccttactgtctccctttgtcaggtacgttttagtaatctttcactggaggtgtaacccttggggccctatgttattcaacaacatcaaatatgattccatatattttctgaaccctcagctttacttacactctccatttggctgaagttgtagggcaagcacctgtttgggagcttgcttgcatctctagagttattactttatttttgacctcttaggatttcccttacttttctgctgactcattcacacattttcaaaaatttaaaaaatatgttttatctacagttttggttgttttattgctgaagattatctttctgggtatctattatgcccctggcctatttttcaaaaaaaaaaaaaagaaaagaaaagaaaagaaaaaaaattccaaagggattaagcgtagacctcaacgtgatctggatcaataccttaagacaaattgaataacattagctccttcttttaagcttccaattcctgggagaataatttcagaaatatactgaaaatttccaaagtcagttttttccagcggtaaaaataaaaccactctgctctcaagagacttctgcactagtgcctagttttagtgagtgtggaagtttctttgagttaaaaagtactgctgcatattacctacctggtttttaacaatattacacaattgtaatcttgaagattatgttgcactcaaaaactgtggcagtgaatcccataaaatacttttaaacgaaaaagccaactgtgtacatcaaatgtcagaattaactttattcttacgtgcctattgagaatattggaacacttttcttcagctcaggatgagaattcctgcttctccacgtacttggaaacacagaacttgtatcttcttattggataaaactaataggcctttgatgtaaaatgctaatctatggaatttaaagctctgaataactttggggttgtaggaagttcccctttagtaaccgaataattccataaaacaattggcttcatatggagtgagtaagcatgttactatagtcagtatctgtactcctgctgacttctgttttgcctttgtttaaatcatatttaagttctgtcaacatatgaaacaaaataagatggtgactgacagaccgggtaaaagcctgatttctgaaatccattcacttgagtttgaatcccagatttgtcactactagctatatgaacatgcgacaattatctctctgatgctcagggatctggaatatttatgaatttcttaagttttcgacttgaaaataaagtacaattgagaactgggtagacgttgtgatcttctaggggtgctttcctaaatttccttgattctagtatggcaacagataaatttgtcgtgatgtttttcttcatacagagaaaataaagtcagcagaaggaagaacaacttttacttttgtccctaaagattaattatcataaaaagacagacaagtatatctatattgtttcaaatgcccttatacatttgcacattcattatatgtaagaatgtgtttctgtttgtcaaatctcttcaactttgtctatttagatttgccctcaaacagtcattcatgaagtatttacctctaaaaatgattaatagcccaagtggtatgattcccaatcttgggcacgaatgctataccaatctaaataacggggttcccttcccaatgagaatctttcacaagtctgacagccagcattttcaaagtttgcaaactttttgtaactaaacataggttgtgtgacagcttctattatttgcccaataacagctcttatatgcccctccttcttaggagctatgccaatgttggatcatagctgtgagtaatttgggtcaaaaagggagacgataaattgggggaaccaactcatggaacattgagtgcttgtcagagaactgatgaaagacttggattcatacctgggaatcacagctttatctaatgcttacaaaactcaagacataaaatacgtaaaatatgacatgttccatgactacaatgatcccttccagccaaaaaggggtattaagatctgattaagtaggttttgctcagcatcactggctcttaatgtagcaggtgtgatgtccctctgtgagataactccagtgaaaattcgatttggactttactttataatacatactaattaactttttattttttaatgagacatactattgaaaaacaatatacccttataaaatattggagtgaggtcaacactattaaaaattcacaaaattgttgagccatttggcaggtgaagtccttgttttgcaagtgcagagattactccagatctcattctgtgccccaatagtggtcccgtgtaatatcaccaagttaaacatttttcaccttttcttagttctccatttgaattgcactctgcacatactggataaattttactacaatccagttgtcagctatagcttagaaaagtttaacctttaatttcatggctcataggaagttcaatgccgtttcctaaatttctgcatattcacaaagaggtcataatgtcatggacaccactggctttaccatcctgcttattctgaattagtacatagtagaaagtgtttacaaagtgtttatccagtgtattctgcatggcatcattcattcattcatttaacaattatttattgagaccctgttatttgttacgctacattatgtgtgaggaactgggctggttgtaggggaaacaataggttagtgtgggaagaagacattaatgattgcacgataaatagaacattatgaataagtgctatgatggggctgagtatggtggtacaaaaacataaaataagtagattttatctagtgtaggagattagagatgcatccctgaaaaaaattactattattatgtgatccaaaaaaaacagattttaagccgaaggtgatggtaaagagttgttccggcaacttgtccaagaagctaagtggtagagaagagaaaaggggcagggtagtagatgtagtggcatgtaggacagagaagggtttttttttttttttaaatagtagtaacttaagtcctgatgtgaaggattcagttccatgagagagtgtggaatatgacagtgatgagggataacaaatcatgtatagttcatgaggtggcatgaacttatataggggaagagccagccctctcttttcacagaagagaaggaggatactgcaagggtagagatttgattggtaggtgagggaaagataaaagagttatcaactgatgccttctcctttcttttaaaatgtcaggttaagtctgataaactggagaggtggaggagaaaacttgatgctttgagcaaagaaggtttgaaacagctgttgcaaagggtaggagagtctacaggcactgttgagggaccctttgaggttggagagatttttctatttatgactggaccaatacactctattaaaaggactttctctggcaatgtttacaggaatagcaaaaacagatggttgtgctatagaaggttgggatttaattaaatgccacacacataaaagaattggcccagacaagacactcagcttccttaattcttcctactcccacacatacatcctcaaaaacccattcataaaagctttttgatttgtgcaccaatttacttaattttgaaggacaacaggaggtttgcattgcggcaattcagtcaattaaaatcgattacacatcttttgcttaaaatgcctttgctcactgttctgttgattggctcttcactctttccctttctctactttgtctgttctagtctactcccttccttttcccttaatttctgatcatttctaatgcagagccattgagctatcccttctgttttattgcttcctgctaaaccaggccctcagggtatcaccttctcccagaaataacttatccacctgttttcctaaacaaagaccggtccctctttaaaataaattcaggtgccacggttcagtgggtaatttttttcaccttgacatattttttatttaatcctgttttttatttgtgataacttgctctaaagatgcctttgttgttttcaatgatagaagaaacatgtttgtcatctcttctgtcatcagccatcaaatgtgtgaccctgagaaagtcatttcattgttttagatcagggctagacaagctatagcctgaaagacaatcttaccaactgcctgtgtgcataaataaagttttattagaccatagtcacattttgtttatgtattatctctgtgctccaacagcaggattggttagttatgaaagacactgtctagcctgcaaaagtgaaaatatttactaactggccctttaaagagtttgccaacccctgttctaggtaacactttatctatctgtaaaatgaaagaatctaagaatatgctctctcattatcttttccattttaatatttaaaatgttaaagttacaaattttggtctctgcaaaaaagtcacctgatctgagagaatgtatctgtgtataattgacaaagtagcatttctggactctatcattctgtacatctttattctgctttatttttattaatatatcactctcttgagtagtgtaatttatatatatatatatacacacacacacacacatatctgtttccctccattaaaatataaattaaatgaaagataaaaaatgttttgttcattgctataccccaatgtctagaataatccagcacatgatagatgctcaatagatgtactaagtaagtgaataaatgaattaatagaatacttctcattggaatttccttccagttgcatgtacagagacaggatatactggacaatagatgggaacaagtctttattactaaaatgtcctaaattgctcatagttcctaggagattgttatagactgaatgtttgtgtccccaatccccactgcctgccagactcatacattgaagccctaaccctcctttgaatgtatctggagatagggtctgtgagatgataaatgaggtcataagagtggggcccaaatccaatatggctggtgcccttataagaagaggaagagacacccacacacacacactctctctgccatatgagaacatagcaacaaggtgactgtctgcaggccaggaagagagcccttaccaggaaccaaactgacaagtgccttgatcttgaactccttctctccagaactgtgcaaaaatacatttctgttatttaagctactcagtctgatatggcagcccaaatagactaataccagaatatttgcaaaagacccctagaaatatgtgttgatgatctctccatactcttttcttccctgagggcaacaacattcagccatatactattgatggaatgagtagtgggctttatacatgtgtgatttgtaaatattaaaagtatatcaagcataagtgaattaaaagtaattatcacctctctatgctcagaaattaagggctctgcaccatattagtggacaatcttcttcaaaataaagtgtattaccatagctatataaaatagtgattacaatgtgagctgtggagtcagactacttggattgcatcctggttctacttaactaatggtgtcatcattgacagatcacttattttcattttcttcctctttaaagaaaatagaaataataattacatgtaccagtcagaatgaattaggctatgttgcaataacaaataatccaaagtttatttctcacttcttctacattcatattgcaaggcagctaagaactgtgctccagtgggtctcactgtaagacacaggctaatagagcacactttctggaacactgctagtagcactagcagaggacagagagatcctgatgaattgcatattggttcttgaagatgccacatagatatgacaatcaccactttcacttacatgtcattgactaaaagcaatacaaatgaccatacttaactccaagggaggggaaggagaacactcttaccatggcccagaagagcaagaaatattcgtgatcagctctaatgactaccacattatctcacagaatttttgtgaaaatcaagtaagcaaaagcctccaaagcatgagttacagctctagaaacaaataaagagcttactaaatattagctattgttattatcccgtattgaattacacacacaaaaaaacactcctgttgggaaaaatggaaaactatttttagacttccaaggaaactttgaccccagcaaatgtaagagaatacagacggggttcacagaaaacctttctttctctaactacctttataactccccagatgagaactcaatcatctgactgcaacacatattttcattgtcctcccctcaaattgatttcttggagaacacaacgtagaggaaatacaacagagcatctttaccctgttgtctgactttgatcagctatcttgtcgtttttcttttaagtccaacattttgtttatttctagctaggtggattactgattatttgtagtaattggctacattaatatgtatatgcaggtcccttaccttgtacctctcatacattagcatcatttagaaattgtggctgatctgcaatttttattcctatcacttttttgatgtagtatataaagtagaaagtgaaatagtgacatgaccctaatttacagaaaaatgtaaaactagtagattgcatattgatgcgagagtgaagctaatttgcttccagttcttgatttaactagttatagtactgtatcttgatcaaatcactaaatcgcctctaagataaagttctttatctaaagaattaaaggagttaatttaaacctcatttacttccaccaagtatgatctggggtgacagaagatgatctctaaactcttttctaacttcaaatattagtctgtgatgcaaaacccttggtccatggttacattagcacacaatatgtaggaattaaattagattcctcaatgtcatttcaagctgattttccagaagctcagtttattggaaggaatttaatcgctcaattgtttgacttttcttatccaagtgaaatcaaatttcacaatcccgtgtaattcactcatcaataattattatcaacatcatctgaaatatattcagtctgcaattaaaaaagagaatgccccatgtgacgaagtcaaagaatgataatgattcatccaactgttgaagcttaattgtttgtcacaggcatccacattagaaatctaatgattataaagtccaatgacatttaatttttcaaatctctatttaccacattgtttttcgaacaatgacatttagtcatttttttaacttgaaacttttgatagagtttatgcagctaattttttaaattaaaaaaatccaatattttttcataatctttttatcattttctttgtatctttaataaaatgactgacatttgtaatctcacttttaatttacatcaacttttcccttattaaccaacccaaggatttatatacagaaagaatagtttatcatgataaggaattgtatagcaagttttctgtcataatacctatttatcttcaagagtcacatacttatggtgcatgaaacaaagattcataaaagccaatgaatttagtttgtgtggcagatactcctggttgtttggcccaatggtcatcccaacccttcacacccctttctttcttctcattataaacgataataatagcccccaaaataagcttaccaaccttcctgaatctagaagtggacatatgagccaagtccaagtaatgagatgtaaggggttgtatgccagtgcccttctaggaaaatttttcttttctaataaatcagacaagtgtggcagtaccagccctttcccttcttcacatggacttcattactgcagctatagaactctcctcaatataatgatgccaaaacgtgaagaccaaaggccaacacacccaagacagtggagcacaaaaagatcaagaatctggatctttagtgacgttaaggggcatctgccccaacactacttaccatcatctcctctgatcatcttcttgggtaaaatttacatttctttcagccaaaagcatctcttgccaatatagctggcatattagtttggctatatttgcatacttaaaaattgtatgctttatcttccacacactaaatctatcattatttctattgtaatattttaattaaaaatatctttgtgtaattgataaaacaaaaaatccttaagagattacttaggtatttgtgccttcacatagaacccaaatggtccctcagacaccattatttcaccctaggtttaaaagaaaaaaattctacaacctttttcattaacttctttcaatggcttttaagaacattaagaatatggaagaggaggtggagaatagcctggaaaaacttcaattggcttctggcagttgctgtaaatcctaagagaatggcatgaagtcaggcagtgtgaatttaatagcatctctgggcaacttgggagtctcccacagtgtctcaatatggcaagcagttatttgttgctagtgccttttatgctgccatttatttcgactctgggccttccttgtattttatttttctctgaagttgtttctctcaccctccatgagacacttcctctgttggggaagtacatcaatataattagatggatgagatacgaaacaaatcacaatgaataaacgagagagaaacaggaaaagggtgattattcaaggtcacccatgtttggcgctcagtttcacacataatctggtcaggcgtgcatgtatctaatgtaacaaatggtataaaaaagcagaatcttctggctcaaaatatataaaagagaaaacctataggagatcattacattattctgaattaactgtcttagaatcttctgtaattttttcccctcagaatgaatagggctacctggtaataaagtctgggactatatggagaagacgaacttgcactgaaaacaaggtgacgatcatcacaaaagcagggacagagttcccaagacaatatatgtgtacaatcacattttctaaatgtggaaaggagatacagatgagtattccatgtttcactgatgtggcagattttaaaatagcacgaattatggttttttggataattttcccctttgattttgcgaaacttaagccctgtcaaggaaaatatgtttcaatattaataattatattttccctcagagttagtacagtgatttgcttctatatttattttcattatactaaaccaaaatctttcacattgaagaaaatatacatatttgcatatatataattttttttttctttttgggcacagagcttctctctgtagcccaggctggagtgtggcgagatcttggctcactgcaacctctgcctcctgagttcaagtgattcttgtgcctcagcctcccaagcagttgggattacaggcatgcgccaccacgcctggctactttttgtattttcagtagagaaagggttttgccatgttggccaggctggtctcaaactcctgacctcaagtgatctgcctgcctgggcctcccaaagtgctgggattacaggcatgagccaccacgcctggcccatgtatttacataatctaaacatgctattcaaagataaggtgggtacgaatagaaagacatatcaaatatacagacggaagtggatgaggcacaacattcttccttttccaaggaggttatcaggtgtctttctctttgtgtgccaaaacaaagataatgatggtcacaaaattcattgaaggctaggcaaaatataagccacatagtagatgctaaaagcaatttctgaatagttgaatggaggaatgaagtggcaattacagttgaatgaacatatgaatgaagtgacattaaaactaaaactagccttatagttttggggaattaaggaaattttattttaaacagtttgctttgcttttagaactataacacaaaccaaaaacattatgaattgtgctctactattaaaacacagatgcagacatttagtaaaatatgaatttattttgctgatgaaagaaatcattagccgagcacagtggctcatgcctgtaatcctagcactttgggaggctgaggcgggtggatcacctgaggttgggagtttgagaacagcctgaccaacgtagagataccccctctctattaaaaatacaaaattagccaggcatggtggtgcatgcctgaaatcccagctactggggaggctgaggcaggagaactgcttgaacccaggaggtggaggttgtggtgagccaagatcgtgccactgcactccagcctgggcaacaagagtgaaactccgtctcaaaaaaaaaaaaaaaaaaaaaaaagaaaagaaaagaaacaattgtattcacctagacagcaatgtgatagaagaaatgttagccttcacattcagcagtacaaatataggaggcttccaagtttcatagagataccagtagcctttagaacaagtgggtttcaccaggttagctattggcacgtttctctgatatgtatctttccagggttgtgtgcagaacagatttctcacccaagtctagaggcatcattcctaccagtcatttttctgctatcaagaaaattatattccctttgtttctagatagaaagatctcagaaaagtcatcctctggacacctctcctgcatgacactcccttataagaacataaagtggcataatgttagatttggagtatacagaaagcaggggctatggtgacattctttccaatattatcaagctctgtggctacgttttgtagaagtttgtaataaatctgtaataaattaataatgtaatctacagctacaatagcaagaattgggcctcactatgcaaatcttgtagaaacatatacagtctcagagaaaattcaatatcttttgccattaattgcttccagtgacttttgggaacattaaaaatgtggcccagcaggaatgagtatcctgacagaaagttcagttggctcaccatacaggcgttctctaattaacatgtttaattagaataatattttaactatgtctcctttaggccacttttcattggtaaaaggaaaattatttctcactaaattttaaaaaatagactattttttacggaattttaggatctcagaaaaactgagctgaaagtacagagagttttcatatatacttaacacccctctcatccaccagcaaacacagcctgctctactatcaataccccacaccagaggggtacattcattccaattggtgaaagcacactgatgcatcattatcacccaagtccacagtttacatgaggggtcatgcttgatgctgtacatcctacgggttttgacataactatataggcatatattaaatattacagtgtcatacagaatagtttcactgccccaaaaatcctctgttctttgcctattcatctctcctgccctcccctgcaaacactgatcttttgactgtctccatagttttgccttttttcagaaacttatgtagtattcagtagtgtgcatttaagtttcctccatgtcttttcatgacttgataactcatttcttctcagtgctgattaatattccattgtatggatgtaccacagtgctatggtctaaatgtttgtgtttccccctttatatactgaaattctaacacccaaggtgataacattaggaggtaaaaccttttgagtggtggttaggccatgagggtagagccctcataattgggatcagtgcacatagaaaaggggtaccagagagctgccttgtcccttccaccatgtgaaggtacagcaagaaggcaccaactatgaacaaggacacaggctctcaccagacactgaatctttgggtactatagtcttcgacttcccagcctctagaactgtgagaaataaatttctgttgtttatgagccattcagtttctggtagtttgctacagcagcctgaatgaaataagacatatatttcatacattcatctactggtggcttccaagttttggcaagtattaacaaagttgccataaacatccatgtgtaggtttttgtgtggctgttttcagctcttttggggaaataccaaggagcacgattgccggattgtatggcaagagtatatttagctttgtaagaaactgtcaaattgtcttccaaagtagcagtacctttttctgttctcatcagcaatgaatcaaagttcctgttgctctacatccttgtcaacttttggtgttgtcaatgttttggatttttaccattctaataggtgggtagcggtatctcgttgctttaatttgcatttccctaacgacatatgattttgatcatcatctcataggcttatttgccatctgtatcttctctggtgaggtgtctgttcagctcttttactcatcttttaatcatattgtttgtctgtgtgtgtgtgtgtgtgacaaggtttggctctgtcacccaggctggagtgcagtggtgcgatctcagttcactgccacctctgcctcccagactcaaaccatcctcccacctcagcctcctaagtagctgggactacaggcacacgccaccatgcccagctaatttttgcagtttttgtagagatagggtctcactttgttgctcaggctggtctcgaactcctgagctcaagtgatccacttgccttggcctcctaaaatgctgggatcacgggcgtgagccactgcacctggccttattttcttattgttgatttttaagagttctttgtgtatttgggtaactcctttatcagatatatcttttgcaaatattttattccatctgtaacttgtctttttattctcttaagtttttgtttgcggataactgataagttggaattcactgaaattaaaaacttatttctttcatgcatcttaccttggtattgtatcagaagaagtcaaggccgaacacaggccatctagattttctctcatgttatcttataggaattttatagttttacatgttaaatttaggtctgtgacccattttgagttaattttggtgaagggtataatgtgtgtgtccagattaatttttcttgcatgtggatgtccaggaccacgtgttgaaaatactatcttttctccattgaattgcctgtgttattttgtaaaagatcagttgactatatttgtgtggttttattttggggctctgtattgtttcactgatgcatttttttctgttttgccaatatcaaactgtcttgattactggggctttagagtaatgcttgaagtagggtagtgttaactatattgagtacatttgcgtgggtctatatttgaacgttgttgacaatgagtggtgaaaggggatatccttgccttgttcctgatcttagcaggaaagcttttagtttctcatcatttagtatgatcttagaagtttttttttttttttttgtaaatgctatttatcaagttaggaaaatatccctctatttcccgtttgctgagagttcttattatgaataaaaaacttcgattttgcgaaatgctttttatgtatctattaatatgattgtgtaattttccctctttagcctaatgatgtgaatgaatttcattcactgactttcaaatgttgaaccagccttgtgtacctgagataagtcccacttggttgtggtataagaattttttcacaaatcgttgagaattttttgcatctagaatcattagagatattggtctgtagttttgtggtaatacctttgtctggtttgggttttagggtaatgctggtcccacaggatgagttagagagtattctatctgcttctatcttctggaagagattgtagagaactgatataattccttccatcaatgtgtggtagaattcaccagtgaacccatctggacctgatggttttgttttggaatatttattaattttttaatttctctgatacagactaattcagattctctgttttatcatatacaacatattcagaattagtctatttcacatatgtttcacataatatttcacgttatctttttaatgtccttggggaaggtaatgatgccctttttcatttctgatatttgtaatttgtgtcttctcgcttgtttttcttagtctggctaaaggcttattaattttatcgatcttttcaaataaccagttttaatttttttctctattggttttttagttttactgatatctgatctaaattttattatagtcatgtacctcataatggtattttggtcaacaggccacacatatgaaagtggtcccataagattataatggagctgaaaaattcttatctagtgacattgcaactgtcataaacaaacctgctgtgttaccaattttataaaagtatagcacatataattatgtacagtatataatatttgatgattacagacaactctgttactggtttatgtatttattcgactgtactttttatcactagagtgtatgctttctacttataaaaaaaaggtaactgtaaaacagcctcaggcaggtccatcaggagggattccagaagaaggcactgttatcataggcgatgacaactccaagggtattactgcccctgaagaccttccagtgggacaagatgtggaggtggaagacagtgatattgatgatcttaactctgtgtaggcctagcgtaatatgtgtttgtgtcttagtttttaacaaaaagttttaaaaaataaaaactttaaaaatagaaaaaagttcatagaacaaggatataaaaaatattttcagatagctgtacactgtatttgtgttttaagctgctaagggttactacaagagtcaaaaagttaaaaaagtaaaatgtttataaaataaaagccattacagtaagctaagattaatttattgttgaaaaaagaaaaacattttaaaataaatttactgtatcctaagtgtacagtatttataaagtctgcagtagtgtaatgtcctaggccttcacattaactcaccacttgctcactgactcacccagagcaacttctagttttgcaagcttcattcatggtaaatgccctatacaagtgtaccattttcatcttttacaccatatttttactgtaccttttctatgtttagagatgcaaatatttcacttccttaactttatttgtaagtattttattctttctgatgttattaaaaatgggattgtcttcttaaatttctttgtaaatgtgtataaaaatgcaactgattgggtcgggcgtggtggctcatgcctgtaatcccagcactttgggaggctaaggcaggtggatcacttgggtgtgaccaaggcctgaggtcaggagtttgagaccagcccggccaacctggtgaaaccccgtctccactaaaaatataaacattagcggggcgtggtggcgggtgcctgtaatcccagctacttgggaggctgaggcaagagaatcacttgaatccaggaggcggaggttgcagtgagccgagatcacaccattgcactccagcctgggtgacagagtgagaccccatctcaaaaaaaaaaaaaaaaaaaatttcaactgatttctatatgttggtttgtatccttcaactttactgaatttattacttttttttttttgatatggagtcttgctctgtcacccagactggagtgtagtggcatgatctcagctcactgcaacctccgcctcccgggttcaagcaattctccttcctcaccttcccaagtaactgggattacaggtgcatgccaccatgcccggctaatttttttttttttttccagtagagatggggtttcaccatgttggccaggctgatctcgaactcctgaccttgtgatccgcccacctcggcctcccaaagtgctaggattacaggcgtgagccactgtgcctggctgaatttattacttctaacagtttttgttcttgttgttgttggggtctttagggctttctatacataagatcatgacatctgcaaacagataaattcactttttcctttccattttgaatgctttttatttttttttcttggctaattgctctggctaggacttctagtactatgttgaatagaagtggcaatagtgggcatccttgccttgtactggatcttagaagaaaagctttcagcttttcacttttgagtatgttagctgtgggctttcatagatgacctttattatgttgtggtacatccttccatacccagtttgttgcatttttttttaatcatgataggatattgaattttgtcaaatgcttttttacagctattgagatgattgtatgctgttaatccttcgttctgtttatgtgatgtatcacattattgatttgaatatgttgaattatagttgcatttcagggatgaattctacttgatcatggtgaatgatccagggataaattccacttgatcatggtgcataatccttacagttgacagccacccaatacttttccctagggcaagagaataagatgctgggactttgggtgcaagtttaactactgtttttttcctcatgaaggagaagtctcaagattattcaccttctgccaattctgcagaaccaagctggctgccgagattcacactggctgcaaagagctgagtgccagctgctgagggccacatacactggctgctgaggtctgcacactggctgctgagaactgcaccagctgctaagattgctaagagccatgctggctctgagatctgtgcattggctgctgagaccatgaactgccctccccgccaccgcccccccgaaccgccactccaccaacttttctttgaggttagctgctcccaggccttctatgtaagtcagtttcctcagaactctgggtgaggcaagacagaagcaggtctcccaaatgatgacccaaaaggctggggaagttgaatggatagtcttccctttctcccatgggggaaattgtgggccaagggtaactcttggtgttgagctgtgccaagtgaagggatagggtaacgtgggtaaagtgaaattgcttttactaattttaatgtactttttttttgggaggggggttgctcttccgagtgctgcaacttctgaagtggattctggagttctcataaaggtattttggtccatagatagttggtagattagtgtttctatggaggtatgaaggctgagatttcctgttgtgccatcttgctgatgtccctcaccctggagttttaaaatctcatatttgcttacattgagcctccagaaatttgtcaattacagtttaggttttcctaccatagtactgattgctgcttacaggtttctgatctgataagctgtgattctacctgcctgtgtgtctctccagtttgaggggcaatggttttttctgtgagttgttgaatttcagttgtgcagctttttacttgttaggacagagtgatgactttcaagcctcttatgtgctgaatcggaaaccagaagttaccacatttctcgttaaatatttgtagccaaaaattggttcataataaaagagaacaagcacctcaacaaactgaagttaaaatgtggataaaggtgacatgtgattaaataattttcaagggaacaagtgccattagatttgtttaaaagtgtgaaagcacctaatcacttttccaccccataggactctcaggtataatctgttggtaagagaccagcagatgtcaagctgtaatttacagctctagaatttaaatcccaagaggtgagttttagttgaaatctgacataaatctttgttcagttctctggtatagttttggctacctgaatgaaactgttctgtttcagaaatactcatatacatttctccatgactgtgtggaaaatctgcattaatttttatcagtctactcagaatgcttgttaattgattccagagaatatagtgataattagcctactcatgtgttttggggtattcattactgtctatggatggttaatgacaacactgtattatggctttatccatataagccagtgacaatgttttccaaatttaagctctctcataaattgaattcaggtttatttcaaatcttgtatgtcaggattaagaatattataatgtttaaacagaagcaggctgcagtagtattttacctatgtattacacttacgcacacaaaggtaaggggtgtaatggagaagagaactgactacgtaaaaccaaaaccgagtagccctttctgctaaggagaggggagctattaactcatataaattggtagacagttcctacactggacgtatttgctttcagatatgatgagggagagacaagctcaggaaaaaaattcaaatctttggctagttctctgcttcttataggtaggatctgggggcagatggaccatcatttacgagaacatatttatgagttttagaagtgcaaaagtagatcccaagttaaatataatagatggaaaacaaggtttttttgcataacaaagagaggaactgagttttagagggaggagataaagaggaaaaatgctgagaaaagatgaataaaagaccctagacctccacggtttaatatggtattctcttgctacactgggtatttgaattcaaataaattttaatttaaaatttggttcctcagtcacacaccagccatatcaagtgttcaacagctataggtagctagtagctattgtattggatagtgctgctctacgacatacgaggtgaacaacaaagtgatgtaaaattcttcaacccaacactccacaaagcttcccatatatacaaaagccctgggtgagaggttttgaggtaaattaaggagaagggctatatatcacctttggggagatgttatacagagcagagtctatatgtataaaataaagacaatccttaaatagcaataaaaaaattttgaaagccagagtccctcagaaacaaaatatggtactttccaaggatccctagaaaatctgagattgactgaaggtctcctaaaatatgtgagctggaattggaggcaattaatttcatttgaatcttataggacaatttgcttcagttaataaccatcttcagaataaatcctccctggcaccatgaagccagaagcctaaataaataaataaataaatagataaataaataaaatttaaaaaaattttaaaaatgatgttcaagaaggggaatccaggacaattttctgtcaactgttcaggaaatactgctttattgctctcctttatctattttgttcctcaaagccttgctctgaaatgtggatttaacagttgatcttaatttccttaagtctttctgttttctgaacaactttatctccccttaacttccaggatttcctattcccagaaactttggctaaaactccccacccaatctaattttaatcccagaacccaactcctgacatcttccctaggaagtcagtgggagagtcaaacagagtcaaagaggagaatcaaggaagtcacaataggggctttttacggctcttgtcatttcatccactgctcataataacgctggaatgaaggcaagagaattttagagtattggcaggagaatgagatgtttgagctgttactctttcttaacctcatacatccctccctatgccactctgctgtacaaacccatgaaaatgtattgtggtctttataagaagactagcagaggccttggggaaactcaacaaaaggattcttgaatcagcttttcttctttcactaaagaaatgtcactttctagtgatggaatgaggtagaaggagtgaccccatgtttctgaatgactcaagccatgtctgacacaaacatgaatatagatgatcaatttctggaaccaaagaatcctagagagtacaggaccccagggcaagccacaccacatggccaatgctaaagattttaggctgacaggctgaatgcataagaatccctcagtggatgtgaaggacctcttcaaggagaactacaaaccactgctcaaggaaataaaagaggacacaaacaaaagaaaaaacattccatcctcatggatagggagaatcgataccattaaaacggccatactgcccaaagtaacttatagattcactgctattcccatcaaactaccattgacattcttcacagaattggagaaaaacactataaatttcatatggaaccaaaaaagagcctgtatagccaacacaatcctaaacaaaaagaacaaagctggagggatcatgctacctcacttcaaactatactacaaggctacagtatacaatacagcatggtagtggtaccaaaacagacatatagaccaatggaacagaatagaaacctcagaaataacaccacacatctacaaccatctgatcttcgacaaaccagacaaaaacaagcaatggaggaaggattccccatttaataaatggtgttgagaaaactggcgagccatatgcagaaaactgaaactggaccccttccttataccttatacaaaaattaactcaagatggattaaagacttacatgtaaaacccaaaaccataaaaaccctagaagaaaacctaggcaataccattcaggacataggcatgggcaaagacttcatgacaaaaatgcccaaagcaattgcaacagaagacaaaattgagaaatgggatctaattaaagaacttctgcaaagcaaaagaaattatcatcagactgaacagggaacctatggaatgggagaaaatttttgcaatctactcacctgacaaacatctaacatccagaatccacaaggaacttaaacaaatttacaagaaaaaaaaaaacaaccccatcaaaaagtgggcaaaggatacgaacagaaacttttcaaaggaagacatttatgcggccaaaaaacatacgaaaaaagctcaacatcactgatcattagagaaacacaaatcaaaaccacaacgagacaccatcccatgccagtcagaatggcgattattaaaaagtcaggaaacaacagatgctggaaaggatgtggagaaataggaatgcttttacactgttggtctgaatataaattagttcaaccgttgtggaagacagtgtggtgattcctcaaggatctagaaccagaaatacgatttgacccagcaatcccattactgggtatatacccaaaggattataaatcattctactacaaaggcacatgctactataaagacacatgcacacatgtatgtttattgcagcactatttccaacagcaaagacttggaaccaacccaaatgcccatcagtgacagactggataaagaaaatgtggtacatatacaccacggaatactacgtagccatgaaaaggaatgagatcatgtcctctgaagggatatgaataaagctggaagccatcatcctcagcaaactaacacaggaacagaaaaccaaacatcccatgttctcacttataaatgagagctgaacagtgagaacacatggacacagggaggataataacacacagcggggccagtcgggggtgggggggacaatgaggggagagagagcattaggacaaactgctaatgcatgtggggcttaaaacctagatgatgggttgataggtgcagaaactaccacggcacacatatacacatgtaacaaacctacacattctacacttgtatcctggaacttaaagtaaaattaaaaaaaaatcccatccttctgtttttgttgttgcattgtttcatttcgattattgtaagttttcttaagtctccagctggaaaattttaaactctcacttaaattttggtttaaagaataaatcaaaggtaaaatgtcacacccttagtcaataaccataaaggaattttttttttttttgatacagagtctcgctctgttgcccaagctggagtgcagtggtgcaatctcggctcactgcaagctctgcctcccgggttcaggccattctcctgcctcagcctcccgagtagctgggactacaggcgcctgccaccacgtcacgctaatattttgtatttttagcacagatggggtttcaccctgttagtcaggatggtcccgatctcctggcctcgtgatccacccacctcggcctcccaaagttctgggattacaggcgtgagccactgcgccctgcaagggaaaattttttatcaaaatatatgaggtatatctaaaattaagtcaggatagcacctattgccttaagtacttattttaataaagaggataaaatttaagttaattaaacaagccttcaactcatgaagctaggaagcaaacaataaaataagtctgaagaaaacagaaaggatgtgaaaatataaatgaatgaaacagaaaagcacagaaggaatgaataaaatataaagttgactctcaataagctttattagatcaattactctacagcctaattgaagaaagaagagaatgtaaacaaagaagatataacgaggaaatagaactagagaaaaataaaaagaattacagcattttgccaacctccattaaaataaattaaagaacttagataaaactgatgattgtaagaaaatataggcagagccaagatgggtgaacaggaacagctcatctacagctcccagctgagtgacacagaagacaggtgacttctgcatttccaactgaggtaccaggttcatctcaccggggagtgttggatagtgggtacaggacagtgggtgcagcgcaccgagcgtgagccgaagcaaggccaggcatcacctcacccaggaagcaccaaggttcagggaattccctttcctagtgaaagagaggggtgacagacagcacctggaaaatcgggtcactcccaccctaataccgcgcttttccaacagtcttagcaaatggcacaccaggagattatatgccgcgcctggctcagagtgtcctatgcccacggagcctcgctcattgctagcacagcagtctgagaccaaactgcaaggcggcagcgaggctggggaaggggcgcccgccattgccgaggcttgagtaggtaaacaggaagctcaaactgggtggagcccaccgcagctcaaggaggcctgcctgcctgcctctgtaggctccacctctgggggcaggacacagacaaacaaaaggcagcagaaacctctacagacttaaatgtccctatctgacagctttgaagaaagtagtggttctcccagctcgcagccagagatctgagaacggacagactgcctcctcaagtgggtatctgacccatgagtagcctaactaggaggcaccacccagtaggggcagactgacacctcacgtggccaggtactcctctgagacaaaacttccagaggaacgataaggcagcaacacctgctgttcaccaataactgctgttctgtagcctctgctgatacccaggcaaacagggtctggagtggacctccagcaaactccaacagacctgcagctgagggtcctgactgttagaaggaaaactaacaaacagaaaggaaatccacaccaaaaccccatctgtacgtcccatcatcaaagacaaaaggtagataaaacaacaaagatggggaaaaaacagagcagaaaaactggaaactctaaaaatcagagcacctctcctcctccaaaggaacgcagctcctcaccagcaatggaacaaagctggatggagaatgactatgacgagttgagagaagaaggcttcagatgatcaaactactccaagctaaaggaggaagttcgaacccatggcaaagaagttaaaaaccttagaaaaaaattagatgaatggctaactagaataaccaatgcagagaagtccttaaaggacctgatagagctgaaaaccacggcatgagaactatgttaagcatgcacaagcctcagcagccgattcgatcaactggaagaaagggtatcagtgatggaagatgaaatgaatgaaatgaagtgagaagagaagtatacagaaaaaagaataaaaagaaacgaacaaagcatccaaaaaatatggcactatgtgaaaagaccaaatctacgtctaactggtgtacctgaaagtgacgggaagaatggaaccaagttggaaaacactctgcaggatattatccaggagaacttccccaacctagcaaggcaggccaacattcaaattcaggaaatacagagaaatgccacagagatactcctcgagaagagcaactccaagacacataactgtcagattcaccaaagttgaaatgaaggaaaaaaggttaagggcagccagagaaaaaggtcaggttacccacaaagggaagcccatgagactaacagcggatctctcagcagaaactctacaagccagaagagagtgggggccaatattcaacattcttaaagaaaagaagttcccacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccagtaccagccactgcaaacacatgccaaattgtaaagaacatggaggttaggaagaaacggcatcaactaacgagcaaaataaccagctaacatcataatgacaggatcaaattcacacatagcaatattaaccttaattgtaaatgggctaaatgctccaattaaaagacacagactggcaaattggatagagtcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacgcagattcataaggcaagtgcttaaagacctacaaagagacttagactcccacacagtaataatgggagactttaacaccccactgtcaacattagacagatcaatgagacagaaagttaacaaggatatccaggaattgaactcagctctgcaccaagtggacctaatagacatctacagaactctccaccccaaatcaacagaatagacattcttttcagcaccacaccacacctattccaaaattgaccacatagttggaagtaaagcactcctcagcaaatgtaaaagaacagaaattataacaaactgtctctcagatcacagtgcaatcaaactagaactcaggattaagaaactcactcaaaaccgctcaactacatggaaactgaacaacctgctcctgaatgactactgggtacataacgaaaagaaggcagaaataaagatgttctttgaaaccaatgagaacaaagacacaacattccagaatctctgggacacattcaaagcagtgtttagagggaaatttatagcattaaatgcccacaagagaaagcaggaaagatctaaaattgacaccctaacatcacaattaaaagaactaaagaagcaagagcaaacacagtcaaaagctagcagaaggcaagaaataactaagatcagagcagaactgcaggagatagagacacaaaaacccttcaaaaaaatcaatgaatccaggagctggttttttgaaaaaatcaacaaaactgatagactgctagcaagactaataaagaagagagaagaatcaaatagacgcaataaaaaatgataaaggggatatcagcaccgataccgtagaaatacaaattaccatcagagaatactataaacacctctatgcaaataaactagaaaatctagaagaaatggataaattcctcgacacacacactctcccaagactaaaccaggaagaagttgaatctctgaatagaccaataacaggctctgaaattgaggcaataattaatagcctagcaacaaaaaaaagtctaggaccagatggattcacagccaaattctaccagaggtacaaggaggagctggtaccattccttctgaaactattccaatcagtagaaaaagagggaatcctctctaactcattttatgaggccagcatcatcctgataccaaagccgggcagagacacaacaaaaaaagagaattttagaccaatatccctgatgaacatcgatgcaaaaatcctcagtaaaatactggcaaacggaatccagcagcatatcaaaaagtttatccaccgtgatcaagtgggcttcatccctgggatgcaaggctggttcaacatatgcaaatcaataaatgtaatccagcatataaacagaaccaaagacaaaaaccacatgattatctcaatagatgcagaaaaggcctttgatgaaattcaacaacccttcatgctaaaaactctcaataaattaggaagtgatgggacgtatctcaaaacaataagagctatctatgacaaacccacagccaatatcgtactgaatgggcaaaaactggaagcattccctttgaaaactggcacaagacagggatgccctctctcaccactcctagtcaacatagtgttggaagttctggccagggcaatcaggcaggagaaagaaataaagggtattcaattaggaaaagaggaagtcaaactgtccccgtttgcagatgacatgattgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggctatactgcccaaggtaatttatagattcaatgccatccccatcaagctaccaatgactttcttcacagaattggaaaaaactactttaaagttcatatggaaccaaaaaagagcccgcatggccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgctgcatatctacaactatgtgatctttgacaaacctgacaaaaacaagaaatggggaaaggattccctatttaataaatggtgctaggaaaactggctagccatatgtagaaagctgaaactggatcccttccttacaccttatacaaaaatcaattcaagatggattaaagacttaaatgttagacctgaaaccataaaaaccctagaagataccatgttattaacctaggcaataccattcaggacaaaggcatgggcaaggacttcatgtctaaaacaccaaaagcaatggcaacaaaagtcaaaattgacgaatcggatctaattaaactaaagactttctgcacagcaaaagaaactactatcagattgaaaaggcaacctacaaaatgggagaaaatttttgcaacctactcatctgacaaatggctaatatccagaatctacaatgaactcaaacaaatttataagaaaaaaacaaaccaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggtgattattgaaaagtcaggaaacaaaaggtgctggaggatgtggagaaataggaacacttttacattgttggtgggactgtaaactagttcaaccattgtggaagtcggtgtgacgattcctcagggatctagaactagaaataccatttgacccagccatcccattactgggtatatacccaaaggattataaatcatggtgctataaagacacatgcacacgtatatttattgcatcactattcacaatagcaaagagttggaaccaacccaaatgtccaacaatgatagactggattaagaaaatatggcacgtatacaccatggaatactatgcagccataaaaaatgatgagttcctgtcgtttgtagggacatggatgaagctggaaaccatcattctcagcaaactatcgcaaggacaaaaaaccaaacaccacatgttctcactcataggtgggaattgaacaatgagaacacatggacacaggatggggaacatcacacaccggggactgttgtggggtggggggagggtggagggataacattaggagatacacctaatgttaaatgaggagttaatgggtgcagcacaccaacatggcgcatgtatacatatgtaacaaacctgcacgttgtgctcatgtaccctaaaacttagataaaaaaaagacaatgcaacttttagaattgaaaaaaacacaacaaaaaaaagaaaatacaaatcaccaaaatttaattcacagaaattgtgaaccaggaaagaccaatattcatggaagaaattaagaagtttatcaaggctattcaagtggatggagaacagatgatttggcagtatttgttttctaagggataaaaaaaaaaggaatcttgaaaatatttaaaagatgtttcatgaagaaatgaaatcgcccaaatatatttttatacacatttatgtacatacaaaacatcataaaaatgtgtattaaaaattaacgtactatgcatgaaatgcagggatatttaagcatgctaatacaattaccatattgtacatcacgtataaaatctattatggtatcaataattacttgacctgacaaatttcaacatacgtttttaaatgaaaccaacacaacaagctaaaaataataatataacatgagttcatggaatcttccctggcatgatgaaaaaaatatctctaacacaagagtaagcactagaagacgttacattaaatcagaaataagacaatgatgcagttatcatcaatgtttcaaactgttgctctgaaagtattcaccaatgtaattaaataagaggaagaaattagaagcatacatatgggaaaggcagaagtaaaacaatcactccaggtagcattcttttgtatttgtaaaactgttagatcgaggcaggaatattataaagaggctaagtataaaattcaatacaaaaaagtattaactttcctgtacgtaaacattaacaaattagagtacataatggggaagaaaatcccatttatagtgacagcaaattgagaaaaatacctgtaacatatataggtatgtttgttacatgtatgttctatatatggttatcatatatgtcatctgttatacataaaatatataatatacatatgcaactgatggaagaaaaattaaaattccactgaaggactaattataaaaaattataaatggattttatctttaatagctagttttgatactataacaattttaagtatttaggaatcaatataaattcaatacagtatcagttaatatatagaatttttaaaagtatgatacaaagcattctaaatttcattgtagtaatttggactctggcatatgattacttataaaatctggaaagataataaaatgtggaaaatattttaaaatacagaataaaaaaagaaatataatgacctctttgtcatattccagataaccccaaggttttctctgcattttatcaaatgggagagtaaatgaaacactccagtgaaatattattgccaatttccaaaggaacacacaatcggctaaaaatacacagtttaaccatggttgcatagaagattacctttatgcattttctcattaagttcttgtatttgcctttctcttttctaacttcttgagatttggctttgtgttcaagaatttctttgctgctttagcctctgatattagccctgtgctgtggtgaataacatggacagttaccctgttaacattctcatgctgtaccctctttatgtggatacaaattctttctgtaagccagacttgcccattatctccccttttagtatcctcaaaccacctagaacttctcttgtggataggtatggagtggtcattagagccctgccacagctctttaaaaaactggaaggacaggatctttctgtgcctgggtgaaagcacactgaagtggtgcttgctgttctttctgctgtctgaggtcaccaagggatggaaatttatggtgaccagctaccaagggcacgaagagcttggtattgtgaccagttttgacttattcaaggattgcaatgttttattttgtaacacagaattcaattttatcaacttttaccgtgtcaagacatttatgttttcttattttaactcttaatatggttaatcacacaaattgatagtatagtattatatcaacatcttttagtagagacaggggtttcaccatgttggagaggctggtcttgaactcctgacctcaagggatctgcctccctcggcctcccaaagtgctgaattacaggcatgagtcaccatgcctggccaaattctcatgttattatttctttttgttatttagaatttgcatccttgaactttttcattgtcaataggaggaacaagtaaaaccacggaagcatgaagatgtcttggttttgaaaacaccatggtgttaggaaaagaattgatcaggaaagtaagtacataagattaaaatcagttgtttttaaagttatttaaaatttccttttagaccacagacacatagtctcttatgggtgacgatctcactcccttcagaatgggagtttccagaagaaatcaagtgtattttctgcaatttatttaattgcctagaaatgtaattgagaaaattatctgacagaaccagcagtgccttggtttcatataggaataggtaaatcttctgcaaattaacctacttgcacagaagaattaatggacatttgaagacttctgtagtaacacttttaatttagtccagctatctataccaaagcaatttggagataatttcagaaattttattcaaataaatgaaggttcaactggttatcatttgtgtgataaatcccatcaccagaatgctactcatttcgacttgcttccttaataatcacgtatcactttattaatattcattcattcatttgttacatgctggggagaataaaatgaattctcctcattttaaatagaatgagattgaagtccaaaggaaaataaattgtatacaggtttcattcatttatatattcattcagtccacatttcttcaattcttactaaagccaggccctatcacgggtaccgataatagatgtcaaaggagttacagtctactgtgtaagagagacatataaagaaataattacaatacaatgtgtacaggcatttccaaattaggcagaaatatacccagtattaaaatatttggtatcccagtccacagtatcactctttttgttcaagagtctttgtgctcctttgtcaccatgttctttcatcttcccaaccactttccacagtgatatttctaaagctcacgtcttataatgctctccactgatggaaacactaacattactttcccaaccctaggaaaagggtatgttaggttacacacaagacccaatctcactgtttgttcaatcatattcctttaatatctctcttgctgttaaccagcatattcagcatttaaaccatacaaaaaaacctatcaattccctctaactccccaaatactatatttctgtgactttgaacatacttccgatcacctagaatgtacctcttgtacctacattgaagactcttttttaactgttaccttctgtttacgtacctttatgtaacctctaaggagagaagtcaccacttctttgtcctctgattatatcttgttttaccccatcataggccttgtcatactctattccatttatttgtttacatgcctgtctcctatcaagttatgacctccttgaaatcatgggtaatagcttatctttttatacacagtgcctaaaaatttgctgagatacgatggatgattttttaaaaaattgtcagacaggctgggtgccgtggctcacgcctgtaatcccagcactttgggaggcccaggtgggcgtatcacctgaggttaggagttcaagaccagcctggccaacatgatgaaaccccatctatactaaaaatacaaaaataagctgggtgtggtagcctgtgcctgtagttgggaggctgaggcaggagaatcgcttgaaaccgggaggcagaggttgcagtgagccgaaatcgcaccactgcactttagcatgggcgaaagagcaagactctgtctcaaaaaaaaaaaaaaaaaaaaaaattgtcaaacgatttcagttcccaacaggagtactatgagatagggaatgaggtaaattgactttctgttttcctcccaatctaaagcagtggattgcaaaatgtggtttctggacttgtaatataaatatcatctgagaatctgttagaaagcactatctctttgcctggacaagtaatttatgaccaagttatgaaaatcaaatgcaacagaaacaaaaattgatcactggaccctaattaaactaaagagcttctgcccagcaaaacaaactatcaacagagtaagcagacaacctacggaatgggagaaaatatttgctaactatgcatctgacaaaggactagtatccagaacctataaggaacttgaacaaattgacaataaagaaacaaataaccccattaaaaagtaagcaaagaatatgaacagacagttctcaaaagaagacatacaagcagacaacaaacatgaaaaatgttcaacatcactaatcatcagagaaatgcaaatcaaaaccacaatgagataccatctcacaccagtcagaatggctattaaaaagtcaaaaaataatggatgttggtgaggttgcagagaagagggaatgcttatacactattgatgggaatgcaaattagtgcagcctctatggacaacagtatggaaatttttcagataactaaaaatagaactaccatttgtcccagcaatgccattactgggtatatacccaaaggaaaataaattgttctacgaaaaagacacttgcactcatatgtttattgcattgctattcacaatagcaaagacatggaatcaacccaagtacccatcaacagtggactggaaaaggaaattgtggtatgtatataagttggaatactacatagccataaaaaagaatggaataatattctttgcagcaacatggatgaagccggaggctattaccctaagtgaactaatgcaggaacagaaagccaaataccgcttattctcacttataggtgggacttaaacactgggtacacacggacacaaatatgggaataaacactagagattccaaaagtgattgagggcagggggttgaaaaacttcttatcaaatacagtgttcactaattgggtgacaggataattagaagcccaaacgtcagcatcatcacctaatatacccatgtaacaaacatgcacatgtactcctgaatttaaaataaaaaagaataaattttcaacaataagacagaactaacttggtttgaaaataaacaaaagaaagaaaagcattgtctcaagacctgctccatccttccttcaagacctattaaatcagaatctctgggggataaggcccaaaatttagtgtatttacaagtcctccaggtgatacttatatggactaaatgttgagaactaacaggttcccgcaaaaggaaaattcatgttttaattgcactcagaagtctgcagaagataggagagagggaccacggcagcacatccaaatgaatgatggaaaaagagaccaggccctcctggttggaggtaattccctgacttcctttgtgagaaaggattggggatcaatggtagactcatacctaccacagtatctgcaacattcgaatagtgtagtatagccaagttgtcaagggaacgggttttggtgttcaaaacaatgagattctgtcctggcttccctgttatcagctgtgtcatctgagcttcaggactcttatctaaaaaataggagtaacaatatatctgtcactatggatttgttttaataataaatgatagatgtcatttgcaaaaacgtggatggaactggaggtcattatgttaagtgaaataagtcaggcagagaaagacaaacaccgcatgttgtcacttatttgtggtatccaaacatcaaaacaagtgaacccatggagtggaaggatggttatcagaggctgggaaacctctagtcgggggttgagggttggggggaggtggggatggttaatggttataaaaataattacaaagaatatataaaatctaccatttgatagcacaacagggtgactacagtcaataatttaattgtacattttaaaataactagaacagtataattggattgtttgtaacacaaagaataaatgcttgaggggatagataccccattctccatggtgtgatcattacacattgcatgcctgtatcaaaacatctaaggtataccacaaatatatacacctactatataccagaaaacttaaaaaaaatttaaaaataataaatggtaaagttgcaagaatgcatcttgtttctaattgacacagagtaggattaatttggtcaaaatatatttcatatatcgtatcgtgacctactaaaggacaaaacataattttgactaaaaggatagaagaaagagccccatgttgcttcttctgtactttattaacaggcttcaaggaataaagtgggaatggatttcctttacttcccatctgctcacattgatttgattaagcctagtgaggttctagcaaaaatctaattggaagaagtttaatcatagtgtagtataaagagcactaggcagagtttgagtatcaactgccagttgattcgctgtgagatcttggggaagttacttcatttctctgatcccaatatttccccttgtaaaatgaagatgaaatgatgcatccattctccttcagagggttacgtgagatgcaaatgtacatgaataggctttttaaaatgtgcaaatattagctattagctattcccagttgctctattggggagtatttcttcatattttaccataaggttcacattagcctgcctgaatcctgactgctttaacttacttgtacgtatctgtggatgcatcttggttttgatctgtaatagattcatgcacagagtaaacaccataaccatcaccttgctttgctatataatcagacattttatttttgccctgttagagaaatggaaattccttatggtctcaaattgcctactgatgagtgaactgcatttctcccccaacatttatagcccttaagaaatggagacaccaggtatagtgtttattacaagaggcattaataatagcctgctgaataaaggctgtctgtggtatgtcaagtgcttctagaatactgtgcctcacagttcagcaaataaagccaacctaaaaagcaggtggtgaatcctaattcagggaaagatgtatgctgtaacaggttgttcttagagctaaggaaagtctttatcatctgtctgagcataaggtgttctggtatttgggaaatgggtaaataaagagctactatgtaagttgtagagggctggccaattacaaaaataggatataggactacaaaaataggatataggacatgaattagcattaaaattgtataaaggcagcaccaggtacaagattggtttagaatatgacacggatagattcaattcctagttttcttacctactgtgtaggttaggtaaagtcatagaaatatctgaacctctattttcttatctattaagtgaggatcataatttcttttccaagaagctgttgcaggaatatagtgagaggttacatgtgaaagtatttatctcagtgcctgacccagagaaggtactaacaaattgtttttattacttttcttgtatatattttatctttcttttccttttcttgctctccttttcttcatatttccttttatctttcctaggactcaagtcatcctttatttgaggatttgaaaggcatttgaggacttatacactgactccgaactagcttggtgcagcttttattataattgtagtagttgtgaaaatgactctttaatagatatttctggatattaaaacacctgtgttatccatgtataaaaacaaaaaaccggtgagtggtcaaaaagagaagcagttaagcttgtaatcccagcaccttgggaggctgaggtagacggatcacctgaggtcagtagttcgagaccagcctggccaacatggtgaaatcccatctctactaaaaatacaaaattagctgggcgtggtggcgctttccagtaatcccaggtacttgggagactgaagcaagagaattgcttgaacctgggaggcggaggttgcagtgagccgagatcacaccgctgcactccagcctgggtgacagagtgagactctgtctcaaaaacaaaaacaaaaacaaacaaaagggaagcagtgaagaacaaagacttactttgtaaaaatggttgattccagggatggggcagggaaagtccaagtgaacctggaaaatttggtggtgccagaaagtagcctcaaagaatgattgagacatgttcatagaacacaggaataagcttgaaggggatactctgcccaaatttaggacaattggagcagcaaagtaaataacgatagtaacaaattataactcactgaatacaaactcatgagttcatacaaatatgaataaatgatatagaaaaaaatgggagaagggaaggctctttgttacagtagaattccaatgaatgaatgcagaagaaatgatggaattaggaaattatcatttggtaaatatcataaccaataattaattcagtcaacagtcattatgctaaaactagtgggtgaacgtttgctgtgggaatagggtatttatgccctccacaaaacacttattaattataaaaggaaaaatagtaactttacagtggagaaacctggtggacaccacctccactaaatgatcaaagttaatgttaccagtaatgaaacaaactgacacgacagcctcctgatatgaggctctggagtacacaaactcccttctgtggtattcctaccaataaatgcacaagctgaatctaatcatgaggaaacatcagactgctcccatttgaaaaaataggcatcaaaataactggtctgtgttctttaaaaatgtcaatgtcatgaaagagaagaactgaggaactcttccagagtaaaggagaccaaagagacatgacacctaaaagaaacacacgatccttgatttattgactcctagaagaaaaaaatacatacatacaagtatatatatgtgtgtgtgtgtgtgtgtgtgtgtgtgtgtgtgtacataatctttgttaagtttctgattttggtaattatagtgcaagcatatgagagaatatccttgtcttcctagaaataaaccctgaagtatttagagataatggggcatcacgctggaaacttactctcaactgatttagaagaaaaattatagatgtagttacaaaattatagatgtatccatcttctatctatctatctattgagaggaatattgatacagcaaatatgataaaaatattaacaattgaagaacctagattaggacatatggaaattctttatactattcttgcagttcttcaaaattatatcaaaataaaaagttaaaaatattgtaagaacagagcagcttgacaattgacagattttgactcgagccttggctccactcattagctgtgcgacagtgggaatcttacctaaattctccatgctcaagttttctcctatgtaaatgaagaaaataatactatctcctggggtcattaaaaggatgaaatgaaattaatcaagctagctgcttaccactgtgtctaaaatgtatgaggcactcaataaattgcagctattgctgtcattattattgtcatattagagacctaaaacaaatttagcacatcattctctttgaggagctttctttagaactcctccttgtattcataggctgttatatctacctttattttactaccagttaatactgtgttgtaatgtgtttgtatgtccatctttatcactatgtaggcagtttcttgagggtggcaaacctgtcttttcatctttgtggcccttgtgccttgggtacagctgagcctgatataggtgctctatgactgtggttgactaaacggtggtaaggagaagcactagtagagcaggtaattcctataaatctgaatacataagatgatgctagtttatctgcaccaagcaaatgtttcgtacattctgtaaggctacatacatcacctgtaataatgattgaatttgagactctcgactcattaggataaccgactacagatgattggttttgagtcatgaaaggatgcaaatgagtggatgtatcacaagtattgtcctttggaatttggcagcctggacttggaaaattactcactgagatgctcaagccatcatgatcagttgtaattcaagacaaatgagaacaaagagtgtttacctactgctcacgagaaaaatttcaatttcttagcttcttctcagcccaacatacaaaaatttgtgccagattatagtgcagttttgcagagcagacagatgggtctattacaaaataatttatttaaattcttgccttgcttcatccaaggtacccatttccacactaatattattggcattctttaatttgcctttcttttcatctttaattactgtgttttgcttctctctgagatccattaaagtatcacccagtgatggaattcgaatgaatttttcctaactgatttatgttcagggatgatttttcttcttctttagattatttgaaagtttctctgcatttgctcaagaattaaaatgcccttccaataccctttttcattttgagacatatccactgacaacattccccataataatatttctgtggtctttggaagtcattcaatttgaaggaagactaaaaatggtcaaatgtttgtgcacctaaatagggtaaatgcctctaaaataaatattaacttcatttttacttgacatatttacatagctgcttgaaattgttttgcctcccttttcaaaactgacaaagagccctttagggagatatttgtaagggataacatttaatgccaagtatcaaagatctttggatgtgtttatgtttgttgtatgttatttcttatacatgcaaaacatagtatacgtgcccgtataagaaaataatctatggttatgttttattttaatgaagagccaacagaaactcagaaaagaatgatataaataatgcataaatcattgagacataagaaatcttgaagtattggtttggttggatattagagatacatggaaatagtccatcactagtttagggttctcaatactctaatcaccatttcttgtccaggctttaaaataatcaatacctcaactgtatccttgtaaagagtttgaaatgtactcttatgaatcttacaaaagacaagcaagtagcattcaacacaaatttatctccttcagggcgcttttagctatcattgctatcatgtgtgtctgctgccttttaaataagtatttttgaattaaaggagagaataaaaagccctcaacaatttccctgttgggtatcagtaaacatccacgaatcttttaagaaacatcattaaatagagtgaccattaagaaatagagggtttaagaatgaaagcgcctgaacatcatggcttcttccacaatgcagttctgtttccaacactgcattatgacctcaaaaggcatcacaatttttcaagtgtcttacatcgagatgtaagttgaaagtgcagttggttgagagctgctggggaatcaaattcattttgcaaagtgagtttgcaaagtaagtcctaattcttatgtgatccttttaggttgaacagaagtctacatttctttcctgttaagtgcagaccttaacatatttaaaagttgacttgaggaagtcatgactatacataaaaaccatcctgtgatctttgaaagtccaagatcattccaagactgctgtcattttaataaatttttgcaaactggagaaggaactacataaagggtgagcttgtaaagatcaagaaatgtatcaataaacccaaagatattctgagaagcatgacagcctccttgagtgttcttttctttattttgcatagtagacattttcttgtgtactataatgcctaccagactttccatcccgtttttctctcaaatgtgaattacttagctcagaattcagcttgagtatcacacgcaaaaacacagacaggattagaacagagatacgcaaagtcactttaaggcacagactattgttttttggtcagaacaagattgtctcaaagaaatatgaagaaaaaagtatccatcggacaagaaggtcattcattaattcatttactcttcaatcacagttgagattatctttgagccttggggtatgctaggcaggcactgggaatacaaggagaaaaaggagacactgaaaagccagcaatattcaagcttttccaaatgccgaacaacagagaggatgcccaggcaagcagatgctacactcttgcgcatctggcaggtatatccctattttggaccatctgatgctggtataagaaatctttgagtaacttctcctcctgctctggttccttactcacaaagcattctgattatactaatatgctttcctgtgtaatatgacaatagggagaaaacacatttaccctatgaccccagttacatacccaccaggggtgggggacttgagcagtgacatttcacactgcaatcaaagaggttagtattgcagtttaaagacttagccataatgtagtaacattgtgagcaaatcttaccaaatattctacttgaaggcctttgtataatgtagtttctgcctctccaggctgagaagactttctttagacaactgttccatttaaatccatagttatacttgtatatatgtattctggattttctctgctttattcatatgccctcttaccttagctatatatagacaaatgttgaggttttggatttctttagtaaagatttctggaaagactttgtcttcattaaaaaaaaaaaaaaaaaaactaccctcacttcatcccattaaatttatgacaaaaaattatttttaaaattgttcttaacctggtgcatataataggtagaaaacatctcggcctgaacccttctgtttcttctctgtgtgacatgtatatagacctggcaggcactcggtgtccttgattagatggttgctaatcaggaaaggaggacattccaactgtgctctccagtgacagagatttgtgctcagaaagcagcttatattttttgcctccctctgtcccttcagtgatcacatccaagttattttccaattcttgttgctgtctgctacctatactaaatgaatactaatggtgttttataaaaacctttgtatccatctaagctgttagcctcttaagggcattttcattttcttatttcaggctatgtctttccttcatcattctgcccttgtctctattgaaaagatagcatcttttttagcatattcaaaggcaatgaagtcttttttttttgttagatgtcatcattataggtatggatggatcacttcatatcaacgtcatcctcaaagatcctgagaaacatcttgaaaaagaaaagaatggcttttttggggggtgggggagctggaaattaaatcaaagcaatacaaaactcacccatttaactgccctgagtgaaggttagatatatctaatctatccaagatgcctaacttaaatatttaggtacttttattttgcaagtccctgtatgacctgaaatcagctacccagtaaccctcagaaatttgaactaagaatacttttcatgcatacaccttcctaaaagttcacttcttaccgaaggatgaatccttgggaattcttgtctcatcatgtagaagggcatcttgttgctatgcacaatgtcatcatcgggactcaagccaagtacatgctagaaagcctcaactgttgatcaatggcaagtacatcagcttgtttaaaatatcatggggttctccaggcatttcattttctaattgtgaacaattatttgcatttaatttagatctcatcttgctgcctgcaagtcagatggcaacaccaccagagccagaggaagtaattacataatctccaatatctttccatcaattaatttatttggatgagtttaaatgctaacataaggaagtgcttgatagtgttagctacaggcaggcaaaggggggtgattgtaaagtgagtcatccacattttccagctcagctgtattatggttagctcatgcttattaaagcaacattgcaatcttgaatttgcttttcagtaaagattaatggaagtcctagtagggtttagcaacatatttagcaattttttctgataatttaccagggttcttgttcagttaatttaattaaaatcagaaagttataagttagtgataaaaataaccactttgaaggttgttgtaaggatcaaatgaggtaatatatgtaaattacttcagttactgaccactggctggctctcgatgtacaaaattcattgtttttgtttctgttaatatcaatttgtttctagaaaaatacaagataataactttgagacaaaatatctcagtaacaaaattcttttactagaaacaagttaggaaagagaaaagagttattatttattattttttcaaacgttaagaagagcagaggcccaaattactaattttattttttatgaattatcgcacatttcatggattgggattttcaaacttttggtgtctatagtctttgctgagacagaagaccataaagacatctagtcaacctactcccagatgccaaccccaaataaatcaatccggaaaactaaagatgagaaggaacaggggtgattaaaagggaagaaaactaacattttgtgtatgctaactatgtgcttagagctgagccagatacgtgacatcaatctatgggcagactttggaattaaactcagttgctgctataagtgcatcattccattttcctagtcatggctttactattaactcttgcacttgtgcactaaggtgggtgaagaggcaggcggggatagggctgggaataagaacaaaaataaagagttggtacagccagactatgagaggagatattctctgaggctttctgctccctctcctcttcctgctccattcacccatgcctgtgggtggccaccttatagttatcgtgaaataatggaaataaactgcgttgcttatcagcaccatgtgagcagcagtgcaatagctgtccagaccttccaggctatacttgtgaatttccagccacaaagcaattcagattaaagggacttcctcttttatctcttctctcccttctccctctgctgacagggaacattatcctgataccataggcatattatatcatcttcttttcaaaaaggaaataaaaaacaacctttatagcttactgaggattatgaggcaaccatattaattccatccttcttaagtggtttatctgtgttgatatgggatgtgagtgagggtggattcctccatgtgtaccgcttgcctacagttggcaaaaactagtagggagcacaaaatgtatgtgtttgtgtttatatgtataagaggcggtggcctctaatttcatcccaaggataagtacaaagtgaatgatgtcagctattgttttgaattattaatatttaccttttcctctagtaagaaaaacatttacagattgactatctttccttaagccttcttcaatgtagaatgttcttaatccgtccctcatgatatttcttcatggaaactgtcaatggttaagcacactcctttcaaaaaaatattcttcctttatgtcttcctcccattctggatgtaattcttcccctctgcttctatatatgattttttcttatctctttccaactccatttcacctcttttctgttgtgcttcttttcactgcattatcttatcctaaaaggttccttattttctacacagactatagagtcctgccttcctctagctaatgaaaagcagtttccttacacaaatttttcacactcataaggcatcatgaaagtaacttgcttctaaactaaaaaagaaaacccttaacatgtcagaagcgcaactgatgagtttctgattctcaggatgcttatctgaacctctccaaattttgagattcatcaatgtctaataaatatgtcacttgcaaactctcttaagcgacaatcgcatatcaagctccacatacaatttggaatacctaaacagccatggtgccctgacatacttttcgggcatttcaaatcatcatctgtaaaataacactggactttcaaactcaacacagacacaagcaactcaatatatctttgggttgccagcagctccggaggagcccaagggctatttgatgcacatcacagagcctgttcttagacttctctgcctcttctccctttcgagtttgctttcctggcagtgacaataatgaggcatccgcaggcaagtagccatagttagggatatttcccatcccacactccctcagtaagcccactcgctgtggcagagtgagagtatcaaaaatgtggaaactatggcagggaaacactggaatctttccaatcaccgcctccagttggaattacattttactaaactaatctgtccctggaaactttaaagttaagtatccttgttcatagcatgaaattgggagaaaaaaggacctgagttcaagttgtgaccctggaattcacctgctctacaaccttaagtttcttcccatatctagccttcaggctcctcataaatggaatgctgatgattaaaatagtacctctttcataggttgctatgagtaaccaagtaaatattgcttataaattgtgtggcacattgccaggcaaatgatgagggttcaatcaatggtatttgctattttttaatagaattttatcttacactctcttccaacctcaccaaaactgctgggcctctgtgaaagcagaatttaaaaacagaggctgagtgtggtggctcatgcctgtaatctcagcactttgggaggctgaggtgggcggatgacttgaggtcaggagttcgagaccagcctggccaacatggcgaaaccccatctatactaaaaatacaaaaaattagctgggcgtggtggccggtgactgtaatcccagctattcaggaggctgagacaggagaattgcttgaacctggaaggcagaggttgcagtgagccagcctgggtgacagagcgtgactgtcaaaaaaaaaaaaaaaaaaaaaaaaaaccaccagaaaacaaaaaaaaccttaatgtcctctagctcatcattgtgttctacaacatttattcataataatgactggacaaggcaatgttatgctgctgcaacaaagaattctaaaatctcagtttttcatagcccagtgtcagttggacaattgactctccttgacagatctcctagtgcaactgtgggatccaggcttcttgcaacctataatatggccatctctgagtttctcaccttgtggggaatagaaagcatgaatttttatggaggggtaagcacggtgaggccttggatagggatataccacttctgctaactctccacttgccagaatcagtcacatggcaccaatatataactgtgaacccaagaggaagaagtagtatgggtgaacatctaggaagcctatgtcactaggatgatcatagtgaggagaggatgaaagtgtgttaagaaatttattactgctgggttaacacgatgcaaatattaggctgctttctcagctagacaccatacgaacttgtctcagatggcaaagtggtttgacttgagtacttcagaactgagagatgaacagatgattttttcctctatgtatgaattgtaaagggtttcaaatcagttttgtattttcttgcttttgtctttcattcattttactctgtagaaacttctgaagcaagtgagcatgtctcattttccccatcgatttagttaactgaaataagagctatgtaaaaagtgagggagagaaccacagctacatacattaacctggatacatctagaaaacatacatttaggcaaaagaactaagtggcaaaaaataactgcatgctttcatgttaaaaacctagaaaaattaaatagattgtctcaggaaaagtatgtgagctggaaaactacacagagaattaagggaaaaaattttcaaattgtggcatagtgtttacctctgggaaagagaagaagggggcaattcagaaagaaacttggggtgggcacttccaaggctctagtcgtgctccatttttatagttgggtggcaaaagtacacatatattcatcttgctgtcagtatttaagctaaataggtatgttttatattctctcttctatacataataaaaacaaacaagaggtataattagagcttgaagaaaggcaatagacttgttctttggtacttttatattttaccaaattatgttattttgcaaattcatatttggatgggggtacttggacgtaacatttctatgtagtctccagtttaacttgaatttcagaaagttaattaaatatctgcggcctaatttcaaattcaaaacaaggtaagcggacccctagcactctaactttatgtctgatccaaattccacagtgttccatttctctttcgttgcaaatcaaatcaccccctaacagtggctttaaatggcaacaatcattttgttatttaatgatttctgcagattaggattccaggaagcctgtggctggacacttctggctcaggatctctcatgtggttgcagtcagatgatgactagagctagagaatctgggagctagctgggcatctctctctccttgtaatctcagggcttctccccgtgatctctccacatgggttagcttgggttttctcacagtatgactctgctttagggcagtcagactgctcacatggtgactaagggctccaacgcagggtttgagtgagactgcagcagaattgctttttatgtcttcagctgggacgtcaggcagtgtcccttgtgttgtattctgttggttacgagtatgccacaggcccttctggattccaggagagaaattagaccccttttattgatgggagagtggcatgtggacaggagatagatactgctgcaacctccttgaaaaatataatctgccacacatgtgtaattggaatagtgacaggatactttgttatccaaaatagtactgttttttagactaaaaggaggtgctagtaattacacagagataacaagtaaaaatctggattatactggacataccatgacatatggtcaccctggtaatagggcaactaatcttaagaagtggattgaacatttcctacctgaagatttcattaaaaatacatcacctttgtgatctgcctcaccggaattcagaatctttatctcacagagacaaaatgcacagacatcagaagttgtttaaaaaagagtaatcagaatggaaaaatgctttgtaattgctctgtgttctctctcattttatcatggctaggtcacccttccctcccacagagagtcaaatatttaaaattgcaagttgaaagtattatcagtaacacacataacagaaattttaatgtctctgaacaacaagcattttaaactctatgcagatactctcctgatgattaaatgatcctacttcttgctggggctttaacccaatgtttcccacattgtgttttaaggaacattactatagctaggtagctcatagaaagtattttccacggtgaaagcagtttgaaaaatccctgtaaattttatccttcctcttgggattcacaattcatactattaaaggttctgaagagttccacaataagaaacatgttaaactttgctctcagtctaactgagcatttccagaattcatgtgaccatggaaagagattttctttttccccctgaacgtcagcaattaacacttggggaacactggtttaacctaagccagaacgtgagtcgacatttatcaagaaacttggaatgatcaaatgcaattaaatcaaccattttacatatagaggaactgaaaaggaggcatttgaaccattttactaacagattggttaagtattttaaaaagtttgttgcttccctgtgtaagggcttagattaataaatttgccctgggctaatatttaatgaacatgtttagaaggataaaacttatccttctaaaaaagtacttaataaggacatagttttattcatgctttatcttgttatgtggaaaaaggaacccaggtttaaatgcaactgtagattttacatataggggcactttttaagatgtactaaatacaaataaacttccaatgttagtgcaagttttccaaactgggcaggacgttggaagtgaaaagaaaaccccacattatggatgagcaccaagggagtggagtttttaacacacattaaagaattccagaaaacttaatacgatagagtatttcataattttagatacttgagaaataggttttttaaagataggaattgaataaactcttcttactcatcattaagtacattcctcatgccagaaccatggtagaaaatccaaagtaacttcagtctatttctttaaatgtaaaaggaggctaacagggagttaataaggaactctatgaaacacttaatacaaaaatcatgaaataaaaagtaaagtatatgttctaattaaaatactctatgtttatcttaactattatgcatatactctctggcagtacatttactgcatgtagagaaataaaaccatcttgagaaatttgcagtaataagacaaaccagataacagcccatttattaacaaccccgaaggggacattttacttaccaaacaaaaacatgtaccatattatagatggtatagttttgctgcattgattacctagaaacagttaaaccctcgctagacttgacaaataattaatattgggtaaaaacattcagaacttctctattcaagaaacattcttcaacttctgagaggtggtagttcagcttaggggctaagagtgttgtctctggaatcagattgcttcggttttatctattcattcagcaaatgtctgttgggtgcctaacatatgttgggtgctgttataggtactgtggatgggaacaaaagaggccagaaaacccctgccctcattgggcttacattccattgatggagacaataataatgagataagtaaaatgcatagtgtgttgaggaacagtatgagctaaggacaaacacaaagtagcaatgaggaatagcaaaattcacttctgtaattttagataggtggtctggcaaggtcccaccgagaaggggatgtttgagtagggacctgaaggtaatgaaagattaagccctgtgcacatactgaaaaagggattccaagcagaggaacagcaattgcaaaggctccaaggcaggcatccgtaacatttctggaaccgtgaagagtctcacgtagctggagctgagtgagaaaggacaagtgggagataagaccatagggttgagggttagaggttttataggaccatgaaggccattccagagactttggcttttactctgagatgggaagtcattggaaggttttgagcagaagagttacttcatctatgtttcagaaggatcactctggcttctagtttgagagtagacaaagaggggcaagggaaggcttggggagtctagttaggaagcaactgcattaggtacgagatgcagtgttttgctcagggaggtggtgagaagtaacagattctgcatatggtttgaaggaacatcagacaggatgtgttgatgtttccattgagtgcaagcaaaagaaaagagtcaaggacaattccaaggtttttggtctgagtaactagaaggatgcacttaccattatgtaagatgggaaaaatgtgggaagtacagttctggtgaggctggggcaggtagtgggagatcaggagttctatttggacatgtgaagtttgagatacttaacataattcaagtagagatgttaagaaggttgatggatacaggctggagtttagaagagaagtctgggttggagttaagcatttcagtttgaaacctggctctgacctttacaggctgtgtgatcttgggcaagttgctgagctatcccactcctcagtttcctcatctgagttattgtgtgcactaattcacacaacatgcttggtgccatgcctggcatgttgtaagcacacaacaaatatggttactttacagttatcttaaaaggcatgtagatggcattctttcagtatgaccataatttcaatgcaaggcttaatttctccatctcaccaatgttatcatctgatttactcaggcttggaacttccacatgacctctggcaattcctttgctctgctttttttttttttttttgcatcagttctttcttcaatatgtcacattcgtttattcctcacctccctttcctatttccaccattcgactaaagagggtccccacatgtataatcatgcaagtgttgccacaacacaacttcatgggaatgacattgctggggctgtgtagtattgttgggggtggggaggctatatcataagctttatctgtgaatcatttccagtgtcctccacagaatgaggtatggcagagtgactagcagcttaggctttagactcagacatgtgtgtctttgaatcccagtaccataacaacatcttggacaatttatggaactccttaagtctcatttagtcctctttacaaagagcactgtaatatctactgccaggacttgtcatgagaattaaataatgtataaaaagctcttaggacagtgcctggcacatggtacgtgatcattctcacacagggacaatttgtgtccagccttttctcccttcattctccaaacatgtatcttcccctgtatcagatcagtctacttccctgggccctaagcattccatgcttattccctactctaagactttgtttatctcctatccactgtttggaattcatttctgttttctttcctcctgactccagttaaaatcaaatcctacctggtccatgaaacctccccctccctcgtcttgacggttcataatatcctctatctccttaaaatttccaagtttcttcctgttcacattacccatttcatacacgtttgccaccttttcaggaaggtggtaagatacagaggaaattgtgatgttaaccattagaccaggctgtaggctctacctatttgggctgggttgccttgccttgatcaaattatttcatttcttctataagatgataacagtaactcctgtatctaagattttcaagagaacaagatgggataacttatgcaccttgattttggtaagtgatgaataaaacaaatagttgtttccttttccttcatgtgccttatttctaactagattgtaatattctgaagagcagggatttatgtgtgggttacatttacttgtatttgtgttagtttaaaagccattgtggtagatcctatcttaatagtaatccatagtaagaaaaatgcatttctaccatgtcttggcccacttgtcaatctcatgcatataacaaatatgtatctgtatctacatataaatgaatatataaacatatattcacatatataaacacacatttttcaaagctttataaaataatacctttcctgtataagatgcaatctgctgtactttattctctttcattctattctattctatatttcattaaaaatccagttgctacacacgaaattgattttatgactctctaatgggtttgaccgtgagttttaatcagtgaaaacactgaaatatcacattgtgggcaccacataattgctggatgagtacttgtgacatggaaatgtttttcacggtgtcttttcacggtctccctggcaatctccctgccaaaaaagatgagacaaatgagatatacatttccaacttgataacttggactctgggtcagtctgtatttgggatgtgtccttttctataaaccacacagcataaatatgctatgatctctgacagcccacttacaatttcagtgtgtatcatgacacgctgactggcctcctgctggcatttgccactgtgccattgcagccagttacataaatcccttagggttctgggccagtcctgggcactttgtcctctgtgcatgcatttggctttttaaaaaaatttccaaggattatcactggttcgctacttctgacgtgttctgtgagaggttctgactggcgtggaataaacttactcttcatttttaaccccaatcaaattaagaatcaatattcctttgaaaaagaaggaagtacaagagagcagtacaagagaagtacaacgtggggcctgaatgttcttcacacatcatctcccgcacatgagattcccttcctgattccaatgactaaacttcaaggaaaatctgagttttctccagagttcatccaaattcgatcaatgtctccatatgaaactacttcctaaaccttctgcctgaggctttgcacagtacaaagtgagaaagaaagcgtttcaggcccgcccactaatctctcccacacactttcatgagttctgctcttataaaattatagcctctggcagagaggaccctggcactgtattccaaaaattattggactaactgaaattaaagcaatatgcacctggaaattaactacgtcttgctgtgcagtagaaatatgtagaaaattactgccctcctgccctatactcagtgaggtatatcagcagccaaaagaagcctgggccccagtttgcaaacagaattttagtgtatatttgaataggttcattccgacaccattagcgcatatttgaataggtcataaaacgtagaatcttaggaccaggtattcatacacagccccagcttgtataaaacaaattaaatagacttcagcatttacatgtttcttggcgtttatcacacatgggtaaaatgagattaaaaaggctgctttttcttgacattgggaagacctacaaaaatttaatcaaacctgagttgactgagtagatatatttggaaaagagacaaacaagttttacacatataactctgcatttcagcaatatttattttctttcatttctgtgtctatttcttccttaacacatagtagggattctatcaatattggctgccttgaatgggcaaattaccgtcaatttgagcctctatgaaaaaaatctggcataggcattttatcagcattaattgagggtcttctatatgccaattctttgcgtacaagggaatataaaaatgaataaatcaatgttatttgtctccccaagaaacgcctgtttagtaaggagagtaaattgaaacagttaattacagagagctgtgataactgttcttacagaactaagaaaggtctatggtaacacaggaagaatgatgacaaaatcaaagagtacttcacagaaggaggagcatttgggtcaagtaatgacatagatgacatattttctcctttttgcaccatacagaagggtctaatgatatgttttttgtcacatatttgatttcaatctcagctctacatcttacaattacaaggcacttacagcctctgaagctcagtcttctgatgtgtatgatggagtgatagtacctgtctcgtaggatggtggtaaggatgtattgagaggattcttgtgtagcaatgttgttggtatcctacccacatcccctcacctttattgcttcagtgaaggctactcttacttacttcttacctgcgttttttgctgaagagctatgctttgtctgcccatcagtgcttaccttgcctgccacgtggaggccagaagtgctggagaattaccatctcacaagagtagcttatagttagtaactagtgggagctgtggaataaataccccatctcccttgacccttcaataggataaatctgatgcatatgttttatggtttccctgagtttctttgcaggattaagctctagtcacatgcagtggtagctggtttcataatgtaccttttaccagctgccatccctttcctgtaccacgtgcctactcctctaccaacactccctgaaacttccagaaatcactagcacttcaatccttgtttcaggcctcatgtctgggaaaacccaagcactgatcacagcacttggcacatggaaaatagaaagcggtgagtgaatgatgagtgatagtaagcaacatattgcttccttctggttaggtatctcatacagccctttacttgcctctaagttaaaactggctgaaaaatcaggcacagcataccagatatacccttcagttttctgtaccttgtcaaattgctggtggcccattataagcacgtacacaagactatttgtgaataatgcatactgttagctctctagtttgcctttgctcatttctcattttggagactcttttgtggattacatgctcaaacacaaaatctcgctaccattttttgattcttagctaatatgcaggaaaacagaagccaactggattttatcattcatctttgttaccatgtccatgagagtatgtgataaatggtatcaaagaatagaatcctagagctgaaagaacatgcatatcatgtagtcctaacccatcatttacaaatgagaaaactttgattcacaaaagtaaatgactttcccatgacaacatggccagtacatttattctgtgagtgtctgtctaggactcaggcagattgtgaagtcagatatgccagtatgctgttccatgttctttttggtctccatccccacccccatccccattgttcctctaccttttgtccttatgtggttcttccctttcctctatcaaatctgttttcagaaatggacttaaaattattcatagtgaaaatgactggaaacagattccactgtgacacatatcaaggatatttttattttagcagggatcaaactgttcagctaaagtggtggaacatttcagaaatccactagcaggtaggacaggtgaaggaggtaaataggattcttctttgaatccctgaaatctcatttattacatctttctctgagtatgttgtccaatattaggcatagtatgtctaaatagtaatgctatgagatactgtggataagaacacacttaatataataaagtgccaacaagtaccaaaaacaatttgcactggaacattcatttccagctcgtcttccaagtgggaaatgatctttcccataaaatagatttcaaatgttattattactacatcccacaaaacaggaatcctaaaaagaaaatctgccaaagagaatagagacacttttagtatataataaaactgtcgggtaacatgaagaaatagaatgtggcagaaaatgtacagatcacagaaacaaaaggcttcagctcctgaatggtcactaaacatttttaagcttcagttttcttatctgacaactgagttactcatctttgccctccctacctcacaggaatgctgcaaggatgacactaactaaaggataaggatataaagtatacatgttgtcaagtatgagttgtcatagagggactatatttatcatattttctaaaaacagtctcttaatggctttttatgatatatacagagtgatgaattgtttttgttaaggtttaattttgctttcaaacaatgcagaaactaaacactgggactatatgctgggaaagatcatcatctgtgacttcccattgctatcccttttgagcatctccactgtctaagcggagactctcccctgttttctgcagtttggaaaggtgttaagacaatcacaaattggtcaccattgtcagtaaatagtctttcgttataaatttcagatacttctctcaaagtccagataagaagcagggaggataataaaaatctgagaattttataattggaagaagctttgttaaattttgtcatttacgacatgagatactgagtggttgcatgaccttcctaggtccaataactaggtcttgagttccaccgtaggcaactgtgtgtcaaaaagtgagacaaggaagggcagaaagccaattcagggtacacaatcaaggcagctgcaattgtgagggtttgaatttaattctattggagaaactctgggagccaatgtagaactggtgcctcagagttatccccctcaaagtgatggagctggagtttgtataccattgtttgagggctgctcccaggaggcaataccacctcagaacttccagcctgctgcactggcagtggggtcagctccagtagcacaagaatgcgttcaaattctctccaaaggtaccggtacagatgctggcagatggaaggcggggccttgtacattgatgtagtaagagtgaggaggtatgggcagggcattgagagcacatctgctatacaccatgaagtggcggagccaggacttgaatccaggtctttagatgcctagtccaggcacgatctactccagcacactgacttctattatatttcattccagttgcctactaaccatgttaggctctgtattaggaaacaggaaataaacaattttatataacagtatatattgaaaacatgtagtgatggtcatgcattggtattagcttggtgttttaaagcctttattttcaaaagtgacattaagtcagtcacaccgtttataactacattgcaataaacaagtctttgattgctttattgactaaagagtatatttttgtttcattaaaagactgttatgcctatttaagaataggtttccagaaatttggtaaagatccacctgtacttcagggacattcacaaaactttttaaaaaacatttctgccaatgtcaatgtgcttactgctgggattggcgagcccacaggctatatcaccaatccaaactccactgttgtttataaggggaaatttattatttatgttctgtaaagaatacagatctatggatttacaccaccatatttatcatatgtttctaagtcctaagttatttttctgtagggagtgtagatggcatggcaacccaaaggtcaatacggttaaaagtcatgcaaagaaatgggtcatataacaacttaatagtggcacttaaataataataaaaggctatcagtttagctaccatattttaaaatatcgttctctccttaatgatcaatgtgaaaggattttgtgtgtgttttcaatcattagtggccctactggcatctcaggaagaaggagggcgtcattacgggtatgaacccttctcctaagctgactctctaagttaaagcaaacatctgacttgaacaaagatataaccacattaatgcaagggggcatctccgctggtttctccccaagccatgcagagagagtgaacactgctccatggttggagagactctgttcactggtgccctaagcacattctggctttaccccctttcaattagtccaggaagccacacataaacaatcggtaagacagaattagttcctttgccctctccccgtctctgatttccctaggaagtccaggtagatgtttattctctgatgagggcagacattagtgtttcctccccctcatacactggtggttgtatggcaagaaaatgacttatgtctctttgaagtactgaatgataatgacgccaaatcctggaaggatgtagaagaatgattctgttatttttaatatgctaattcaatattattaacaaatattataaagaattttatcccttctgaacattcctttttaatattgctgtaaacttaattagcatttgtgttttttttaaataaattatctgtcaattaagaagccaattttcctaagcttccaccttttattttgaactgttgattctatttcaaatgattttgtggattctctctggaagatgaaaaagaaagttcaaaaaaggaagtcctgtcacacaaatccaggtgactttctctttagcttttgacagcaccagtagttaagagtgcacattccataaaaggagagagagcactgagcttaaactctgctgtgctggggaatgttttctgtttaacaagatgctttggaattggcaaagagtaaaatcaagcattttcagttctgaggctcttttacgtgggcaaagtgagagtatgaagtgacacaattatatgggtaattcagatcaactggatggttttcacataattagcagctaacttttgggcattacttagctgaataactgaatctgtttgcagcatcccctcaaatctgtagtatctatcgtttctccccaatttagaattccttaagtcagtcatattagcatcttcgcaaatcagaaacctgtcaatttcctcctctccatgtattttgctatcaaggccagttaattctatcaaaaggattatgaggaggtttccctcatcttaggaatgtaataacacaagagtaataacacatcatttttactctattaaagccctagttatatgtcttttgatttctactctgtaatatccaagaccaaattacttaaagatatttctttcattaaaagtcatccttttactcaatgacctatttcccatcacgtcaagtccaaatttattggtttagttttaaatgttattcaaaagattgtccctctctggccaaacttgatcacctctaaccaataatgtaataactttttccatttaggattcttcattcagacattcatttaaaactagcttgggaggttttaaagataactaagaagtagaaatcagtaagagaaataatctggggcaagattatgtaagagttttgtgagtgatattaaagtatctctttttatcctaaaaggaatgatgaactgttgaaggtttttaagcagaatgatatgatcacctatttttatagaaagatctgactgcacttcagaaaaatagaatttaggggtcagatggattttctgttgactattctgtttcactgcacccccttctgagttcttttctccatcacagaagacaggactacatttcccagaatattatgttatttaccttatagttcactaatgagaggcagttatccaggattttgaaggtagaaaagaaggcaaaacaattattctctggaagcagttgcagtaaaaaccacaggaaaatgtgacattcgcagcagcttcctggtgagctactaagagccaccaacttaagtgcctcaggctgtctttaggcatcagattccttggtcttcaatgtcagcttccttatcctttgctcttccagttcctccaacaattacggagcactatttcatacattaaaccccttataccttgcataaaaagagtggcttccatttcactaaccttaccctcatctgataaagaaaaggttaaaaaaaaaaaaaaaaagaagaaggttgagggccctgttaggaggttacagctgtgatccaggcaaaaagagagaagtctgaattagtttaatggtaatataagtggtagtggcaacagttggagatgtttgggaagtcgaatggactgggcttgctggttgaatggatggaagcatgaggaaaaaaaaaatctcagatgattttcaggtttctgactttagccattaggtagatagtactaaggaactaagtaataagtgatcataaggaacaaaggaggagaatcaggtgaactgataatttcattagactcatttgaggtgctcatgaattattcaagtgcagatatctgataggttgtaggtcacaagtctgaaagaaaaaggaacagatgctgtgaacttaggagttaatcagcatgaagaggagaaggctatgtttacgggtgaacttgcccataggacatatgaacaacacacaaacaaagaggcccaattatagccctgaaaagatcaacaattacaaatttactagaaaacagcagtccataaaggaaattgggaaacagcagccacataagtaatttccagaatttccacagggaaaggtgagatcagaaccctcagtcacacaggacagacatcttctgttgaaggacgggaggaggaaaggactagagggaatccagacttgatggtcagaagtagaggtaattccggcctgatgtttccattttctgtgaagaagctagataggctgcagagggtgaggggagcaggtgatgagatcaaaggtttgaggagagtggagaaggtttgaagaaaagcctttgtggttaacgggatagagcatttatgggggagaaagaagacagaggttgttgtcctagctgtgccggtaaccagctatgagaccttgcaaattattttattcccttctaaatcttctcgtcctcataaccaggtaaataagggagctgtgctacattctctcccaggtattttggagtcctgtggtgacattcttaaattcctttccatctatccaaatgatagccatccttcaagtctcaatgaaagttccatatgttctgagaagaattcccacaagcccagcttctagagatcacttgtagcttaaacttctacagtgcattttctaccacactattgtctgcacgtaattgtatgtgttagaaaaataatttgtttttctcaaagactttaagcacataacttcagtgctgagaggcttataacacaaaactgctgtcccttccccatataactattctgttctctagataccaccatactgaactcaggtatttcttttggtatttactttaatatttcgaatttatgaccccttactgacatgacctcttacttctctgacctcagtgcccacccctcccctttacttattcttctacagccacggtggcttctttgctgttccacaaacaaaggaggcatgtgttcatcaaacatatctggcaggccgctttcctcaacacaccaggaagcctttgcacgaactgcttcctgtgcctggaatgctcttccgggtactatatgcaagactcactcccttactttctcaaagtctttccccacaagtcgccatctcaatgaactttcttaagtggcatctggcactcattgtggcaaggcttatttctttcacttattactatataatacaccctgtattttatgtatttctcttgattaatctctttcctctacccatgtgtaagttttatgggggcaggaatttttgtctgcatcattcaattgtagcactggtgactggaataatgccaggtccatgacaagtacttaacaaatatctgttaatttatgaatgctgctactttgtatttaccaaatttaatctatgactttttaaatatagtaaagcttgaactcacttatagccctctgcatatccccatcctctgttatttaaataaaaatgctgtttacattattacgtctatgttaatattgatcactgctgaacgagtggaggtactaggattcaggctctgggatagaaggcagaagaaagatgggcaagggaatttacagtagtggaatggtcttctggaaggttcgctctcaaaaatatctcctcctcctcctctctgatgcctgaattctttgcactaaccactcacttcttggtgttatgcattgctttcctcctgatcttctttggaaaaatcaatgcgtgtgggaagggtgactcatctgtccaatagctcctcagtgtaaattatttttccagtagacacaaagcagaggtggcacagtgacattgtagttactgaaatgggggaaacaggtgcagaattgagatgagggaagaccaggcaataaatattgaaatttgtgctggtgttgggggaaacagcaacccagggatgagcacgagtcactaaatattattcacatgcatgccacgggcactccatcaaaacaagtcttagaggcaggaggttcttatagagcttagtgaccaatcacctttttctacacataggggaactgaggcatgaggtaatccagcaccacatagctggttaatggtggatttcgttccggaatctgattttttttattctcccagtctgcttctgaatatttaatactgtctcatatgccctttatttaatgaatgctattaattcttggaagcaaatccatccctctttactaatcccagtaaaacacactcttgcagagggcctatgcttccttctagttttcattcttaagagattaaatagaggatgtcagctttcaaatattgcttttattgaactccaggcacaagtcactctctcccacctcccaactgcaaatatttagctactcagaatgttacatattctattattatccagccaatagatgaatagttgccaacaaatagtagtcttttcagcatccaagtcctcagcttgcatcatttgacagtgatttctgtccatcattcttggttttcaaccctataatagctctcaagccatttatttaataccatgtaaatgtgtatatgattgtcatcacatattaatcttttcggtggaatggcattaggcttttagaggaaataaatggggtcccttaatttgcttttatcttccttctagagtagcacttattaaaataacacatgcttatcaaggtgagactttttataaatcagtaatgatttgttaaccattatgcatttctaatgctacataatcctttccctaaacactcttccacatcacttcatggtttaaaatggatcttctgatctctaaacttcctaaatttgcttttgatcttttgttaatatagcaaattcttgtcttttctcataatgcattgttttataatacacaatttggcattgtactgtgttccctgtttaacagcccagacaccacatctggccttctttggggcagaacaatcaggcatcatagggaggggctacacaggacatgaccaaggccaaggtactaaataaacaaatcaccgtacagccaagagcagtcaagttgtgaggttagaagagcctggagtcaaaatgaggaagaagaaagagaggctagtttaggaaggctgtttgatagcctgtggtcttacagcagtgaatgcagatagagcaatgattgagtgcgcctctcatacagaccctaatctcaagaacaaaagtggtgaatcaacaagggactctagaattctgctagataattatctggaagcgaagcagagccctacacatcaaatggcaaaacctaaaatcactaaagagcaacccgaagctacaactgcagaactttggtccaaggtcagagcgggacacaaagttgaaaaaacatggagctcccaaactcatgatccaggaaccttaatttgttcccaacttaagaacattttgtttccagcctccaagtgcccaggcttggctgagcctgtaggtcatggttaggaggctccagctgtgagacctggaagactgccggaacgagaattggactggctgggattatgagttataaaaggattctcagccagatgctctttaacctccctcagtaccttctttaacttttacagaggtaattcatctggattcaatggcttattggcccctaatagttccatagggttaactctctctccaaagtaaataaaagcctttaatatcttttgcagaaaataaagtgattctgaagtcccaggtatgcccttcagtttttttgttgtttgttttgttttttggaagttctacagcaaaacttctcaatggcataacctctctgtagaaactctggttttaatgatctctcagtaacagtgagacttttgatttgaagtcttctaaaaggatatctagttggttaaaaattgtcatttcaactatataccacttttgtatattttctaggcagagttattaatacagtattatttcatttctatctctcctggcttgatacttagacaaatatctaggttgtcagaagtggaagaactcttagagtcttcatcagtatgaacatggtccttttcttatctaaaatgcacatatggatcaaaatgtatagacattttcaggagcttcaaagaattcctgataactatccatggacaccatgtcaacgatctctgcctaggccaaagttaaatcaagatcgtaaagttgggatccacaacgattaagaggtttgaacattttaacctccacagctggtaagctgctcttcctctatgctctcatgtcaccctgggaaaagccgtctctttgccctaacatatgagtcccttccctcactggactgtgagcaaattgaaactaaaatccacttctcgattatttttatactccagcacatacaagatgtgacacacagaaggctccataagtgtttagtaaagaagtccagattcaagggtccataaatcagaaccctgagtgctaggctctctgaccatgcggaattatcgctttcttgtttttccactatcagtaggcaggtgctggggtccccatgggttttcccaccttcccaaaaactttgtgcaactttcctagccattctgattttcagtctcttcatcatatatggataatagcatttacttgcatgttgccatgaatacaaaatattgcatgttgagccctacacacaaattttcttatgatctagcaattaagcatttgaaacgcagtgtatgtatgaaagattccattgtgtgatctgagagccccagcttcaaagtcctgtggaaattaacagcactgagattagagagaaaaagaaagaaaatctatcttgtagatgtctcttgcaggtttctgagacaagcgtcaaaaccaggctaagattagaactgggtcccagaggctctatttcgtatcccccagcctttctgtccgccagagtcatccttgagcttttcgtcacgactgtttctgtatttgtcccgctgcttgtaaccctcacctcactgatgtaagcagaggaaaaacaacaataaaaacagttgacatttacgtagcattcaaaagtttcctatctactgaactacttttcttaaaggcatcctctaacgcagcaatgactaaacgaagcagcagaaatagctattaggttaggtgtgtgggagaagatagctccctctaccccttctcatcatattaattgacccaaatgatagcttttgctccctctgtaccattcattacagacctgcaaggccgggaatgctgaaacagagtgacagccaatcaagtgcttctgcctgtggacttcagcatctgtgagtcatcagcaaccaattagattcttcggtcggggaaaactctcctcaccagggtagaaacaagcaatgcacgctgctgacctttacatcagcaactcgtgtttctgatcacgatggtgaaaggccaatacaggcctgagagccccaccctgacacatgaaaagaatacctttgctttgcttctgtgcagacagcttatggtatttggtgctgtttgtgcttaggtctctttgcctcagaggaagctctgagttctgtctcagaaatcctaattgctctttgcggggcagtttcattggctgcctttttctctggggagttcacagctatgccacaaaatttaaagctgagactcactgtgcctgtcaagagaggtttttctgctcactccattacagactacagagcccccatctactctatggcctgggttgaatgaggtaacagttttgtatataacactggtatcttagccaccatcctagcatctgtgggtctgagctgaactccagtgttcttgtctgcttgtgtcctctctcactcagtgtgtgtgtgtgtatgagtgagagagactctgaaatggactttgtccaaccctaaaccatctgcatttttcctggtcacataataaaaagacctcttactgcagaatttaaatccttccagaattttccttttacctatttcttgatctagagctcctttatcagcagccatacatattgttgctctagggttaatgtaaaaaattcaaagacaggcttggttcacagaatcctagaaaattttactgacgtcatgcagcctacctaatcgtgaacttgtccgattcgaaggcatctctgtccagatcacattcataacttacaggaaaaatgccttccattatagtatttctcaatgtctcccaatttagccctctcccatcaccataataaccagacctgtcactaggagataaaacagcttgttcctcccaatgtaagactcctaatctggagatgttcatctgcacagggcccctccaagcgtcttcctgagatttcttggcatcaagagactctaagtgtctgctatctggacgccaaggaagctctaggattgtcaccttctcttagctccaagggggcatttgtacccatccccattatcagcacgagcagatcaggaatctaaaatcacacagatcttgtggctcacctagggctgggaaaagcaaaccttttctatgaaaggctaggtagtaaatacttaaggctttatagaccataaggtttctgctgcaattattcaactctgccgctgctgcagcatgaaggcagccatagccaaaaatgaatggctgtggctctgttccaatgaaactttatttacggacactataatttggataccataaaactttcacatgtcacaaaagagtcctatttttttcaatcctttaaaaatgtaaagaacattcttatcttgcagagacaagataaaataggcagcagacagtagtttggggacccctggggcagtattcaactgagtcataaggattacttggagtactcttttgtaaaatgtcattttatcacccatatctcagatgctctgatttggtagacagagttaaggtggggccaggtgatctgcttatttaggcagactcccagtgattcagatgctgggagcctttggcttgcactttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccttggcttgcactttaagaaacactgcactagacgggaagatgaaggcaaacttttctaagaaaacaaaatacaggtcatgttttatctttgaaactcagtctggtccccttaagcagaaagtccaaaaaagctccctccattctgaatgtatctacctgcaaactagccaattttaactgtacgctccttttcaaaccattcgactcacgtttgtcactgtcctgtatcttgaccaatatttatacacgcttcttttactcacgtgtctcttccagacgtttttccaagccgaactgtcttccctctctactccttccctgaatgtttctcagccttcagggcctggttaaaatgtcgcctcctccatgaggttttctcaaacccaacggttctcatttcagcctgcatcagaatcacctggagggcttgttaaaccataaattgctggctccaccccagagtttcagaatcagtagattgaaagtgaggccagagaattttcatttgcaatgaattctcaggtgatgctgatgatgctgggtctagtgaccacattgagagaaccacagccttaaccccaccaagccgggggatactctccttcttaattgaatacagcttctgtgttccatggcgacatattgacacaagttctgctgtttggggttagtggcgatcttactgcatgcatactgttccctcaaacagattgtcaaccccttgaggacaggagctatattatattttatggactttttggtatcatccaaagcacaagtagttccccaagcaatgtttgttcggtaactgattgctataatgtaaaatgaataaacttttccacataagtaagctgtattaggattctacagagaaacagaaccaagaggatgtgtgtgtgtgtgtatatatatatattaaagatttattctaaggaattggctcttgcaattgtgaaggcttagtgagtcaagaatctgatggaagaggctgccagactggagacccagaaggagctaatgttgcagttcaagtctgaaagctgctttgtaatctcttgctccacagagggtagtcttttgttctactcacacctttaactgattggatgaggcccacctacattgcgaagggcaatctgctttccccaaagttaaatgatttaaatatattaaatgatttaatttcatctcaaaacaccctcaaagaacatctcaaataatgtttgaccacatatctgggcaccatgggccagccaagttgacaaacaaaattaaccatcacagtggaaaatgtgaaaattttcataaccgaagggttagcctggtctcatatctagatactccacacggttttcccttttaaggtttatatctttgtgaattgaaaaatagggaaataaaggtaaagccaaaagtggtagggactagaggtaggcatcagttttctacctcaatataccctaaactacaacttgtgccataattttatgtttcccagtgtgtgattattccagttaatgcatgaacaaacactttaaattgcttggtatttattttaagggatactagaaaaataaaacgaacatgtcaaaactgtgacaatacatatttactaggatgaggctatgtatttaaaaagtgtccattaaaaatagattatatatggtcactctttgtaaatgatgcgatcttatatctagaaaaccctgaagaccccagcaaaagactcttagaactgctaaataaattcagtaaagttgcaggatacaaaatcagcatataaaaatctgttgcatttctatataccaacaatgaaatagctgagaaagaaatccatttacaatagctacaaaaaataaaatacctaggaataaatacaaccaaggaagtgaaagacctcctagaattcgtatgaaacaaacaacaacaacaaaaagagctcaaatagctaaacaatcctgagctgaaagaacaaagctgaaggcatcatactacctgacttaaaactatattacagcgctacaataaccaaaacagcatggtgttaacagacacatagaccaatggaacagaacaaagaatccagaaagaaatccacatacttacagccaactgatatttgacaaaggcatcaagcatattcaatgaagaaaggataccgtcttcaataaatggtgctgggaaaattggatatccttatgcagaagaatgaaactggaaccttatctctttatatgaaaaataactcaagatggattaaagacttaaacataagacctgaaagtataaaactagaagaaaacatagaggaaacacttcaggactttggtctaggttaacattttgtggctaagaccacaaaagcacaggaaacaaagataaaaatagacaaataggactatattaaactaataagcttctttacagcaaaagaaacaatcaaaagagtgaagagacaacctgttgagtgggagaaaatatatacaaactgttcacttgataagagactaatatgcagaatataaaaggaattcaaacaacaacataaaaccaaataattccattaaaaagtgaacagaagatatgcacagacgtttcccaaaagatggctaacaggtatatgaaaaaatactcagcatcactaatcatcagggaaacggaaattaaagccacaatgagatatcatctcaaccaagttagaatagctactattaaaaagacaaaagataacagatgctggtgagaatgcagagaaaatggaatgcttatacagcattggtgggaatgcaaattagcgcagccattatggacaacagtatggagatttctcaaaaatttgaaaatagacctaccatacgatccagctgtcatactgctgggtatttatccaaatgaaaagaaaccaacatatcaaagagataccttcactcgcatatttatcatagcactattcataatagtaaagatatcaaatcaacctaagtgtctatcaagggatgaatgaatttttaaaatgtggtacttatacacagtggaatactatttggccataaaaaagaacaaaatcatgttatttgcagcaacatgaacagaactggaggtcattaaataaaataagccagacacagaaagacaaatatcccatgttcttactcatatggggagattaagaagttgctctcgtaaaggtaaagagtagaatgacagatactagagactagaagggtgggtgggaaggtggaataacaagtttggttatagggtacaaacatatagttagctacaaggtataaatcataccatttcatagcagagtagagtgactttagttaacaacaatgtgttatatatttaaaagtatctagagagattacttgaactctttctaacccatagaaatgataaatactcaaagtgatggacgctcttaatgccgtgacttgatcattacacattctatgaatataacaaaagatcacatgtaccccataaatatataaaatattatttatcaataaaaagatcgatgtaagcataaaagcttggggaaaggacatacttggttaagaattataattacaaacaacgatgcagtttaaaaccttttaaaacttcatactgacaacatacttcctaaggtgatctctctgcacttttaataatggtgacactcatatcatttgtaatatacaaccaaagagaataaaatatcttcttgttaaattttataaaatcaaaacaaatatattgtgtagataatagtacagtggtaaccaaaagaattgttcaaaagaaagtaaagactctgggagtaaagactgaatcctgaatgaaagctttcctgcccagcagggaagctgattcggcacagagtttatgttctggggcaagaggcttggaggacaatattaactttaaatgtaaatggactaaatgctccaattaaaagacacagactggcaaattggataaagagtcaagacccatcagtatgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcatccaatacaggagcacccagattcataaagcaagtcctgagtgacctacaaagagacttagactcccacacattaataatgggagactttaacaccccactgtcaatattagacagatcagcgagacagaaagtcaacaaggatacccaggaattgaactcagctctgtaccaagcggacctaatagacatctacagaactctccaccccacatcaacagaatatacatttttttcagcaccacaccacacctattccaaaattgaccacatacttggaagtaaagctctcctcagcaaatgtaaaaaaacagaaattataacaaactatctctcagaccacagtgcaatcaaactagaactcaggattaagaaactcactcaaaaccactcactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggatagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaagaaaagagagacgaatcaaatagacggaataaaaaatgataaacgggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaactcattatatgaggtcagcatcatcctgataccaaagccgggcagagacacaaccaaagaagagaattttagaccaatacccttgatgaacattgatgcaaaaatcctcaataaaatactggcaaactgaatccagcagcacatcaaaaagtttatccaccgtgatcaagtgggcttcatccctgggatgcaaggctggttcaacatatgcaaatcaataaatgtaatccagcatataaacagaaccaaagacaaaaaccacatgattatctcaatagatgcagaaaaggcctttgacaaaattcaacaacccttcatgctgaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagaaattctggataggttttcttaaagctgaaaactgcagtctctgtggcccatattgggaaagcaaagcccactagaccctctgattgtctggcattgtctaggccaattccttaggctgtgtgtaagtgttgagctggttgttggcaggttttccaagaagtggtccttgaagcttttccaaggagtgtgactgatttaggaatgtggtgcctgagttgttttgtggctcctgatttaggattagggtgatcgagaatcactttagtggaagccaggtctgcaccactgtctgcaggcaaggcagccttatcaggatttgtcactgcttaagcgttttcctttctgagacacttcttttcagctttgcagacccacatatgcctgtctctataattcttgccaaatttcttggatgatgaaggttgtaccaaagcctttttcactacatgagatataccaaggaatccttctagaaaggatgagagcagcaaagtagtagagaatggttgtgttcaggccagaatccccatgctggcctatacacatatcacaatgatgtatgagtagattcactttattttgaacagtgatccttccagcactggtccatccaatctccccagacataggcagcaggagcaaactttagagttagaagtgtgcaaattgtgacattctcatataatttactaaaattaaagttattttttaccctgaaactctattacagctagtggcaaaaatgtaatattagacattcagaataactgaggtacttcaatattttaaagccaatttagagttttgctccttctgccctcactctctgaagtggcagctagcttctggaaatagagctgggagagttacatggctctcaggtattaagtgatgtgggcattttgtctgcaggtactttccgttgtccattgtcttttgctcatttcctctgaacttgggcactggcctttaaccgggctgtgtctgtacagatgtctgttgctgtcctgggctggctccttttctctgtgttacaaccatgccctttggaatgaaggctgaagaaaacgtttacgtgttacttcatgcctgctaccctaggaaacaagggataggggcactctctcaggcccttttcatgtagacttgtcctggcatgagccctattccctagctgatacaccattttagcatgggttcttccccatgaggactgccaccctttcacctctatgacctccactcacagaattaaacacagaccttttatacatattcataaactcccccagtcaaatctgcctgcagtttctttaatccaccccctactgccatgataaggaatctcgggtgaagaaggcactgggccttttgttcaggtaccttctgaagttgggttccagggaaaactttggttggaaaagggttataagatttttatgaaaactcaggtcatggtcccacaacgcgacatatatatatatacacacatatatatcgcgttgtatatatgtatttacagatggttttgccatagggcaggaaaaataaatgggactcaaggaaagtgatccaaaagcaaaagcaactgagaggtatacgataatgtaatatcttctctgtgataactacagacaggcagttaaaggtgggaaaacagaaggaagtaaaggccaagaattctaaagccccaaactaagatctgaaaaccattgttgcctgtatttgtataacaaatgggcttctggcttttaaaatgttttagggtaactgaaaaaaaaatagatttctactttagtctgaaaagagaataggagctaaactaagcagcaattaaagtggttaaaggttaatgggaaaagttgcttctagggtctcatatttctttaattttggtctattattgtattgtaatatttaagcctcctatttatattttaatagaaagttacatttttgaaagaaaaagaatggttgatatttgcatttagcacaccaataaaaaatagttttcctatttatactaggagatgacaaactttggctcctaggccaaaggtagcccactacctgctcttgtaaataaagtgttattggaacacagccacaccaatttgtttacatattgtctatggctgcaatggcagaattgagtagttgcaacagagactatatggcctacaaagtcaaaaatatttactgcattactctttacagaaatagtttattggcccctgattcatatgatgaggtcataatccaggtatccacatccaccttgtggcaaattatgtaaattactggtacagtgcttttgagaattaaagaaggtctgtatgaccagcctaataaaatcacacttcacgttgatggaaaatacactttattagataggaaagaatcatctcatctgtagctaatgaaatatgctaactatcaagagaaaatcatagtttccttttcgttagttaactggtcatattaaaaagatgaatctttaaaaaattatcataaagcaagacctacaaaaaatagttaagtccttggctactcttaatgagcacccactctaagcaccagaacttcttgcaattgttaccattttttttgaactttaaaattgatgtcacccatactggcatgatctaaatactttatgtctaaaattttaatctttcttttcattacaaataatgtattacagtattatttgactttgttcccaccatacctaaacccgcctttcttgactctggctgcgcactacaatcattttaagagtttttcaaatgtgctaaaatcctggcactgccccagagaaacaaaataaaaatttttcaggaaggggaccacagcatcagcaaaacgctccccaggtgtttctaatgtatatctgagctgaaaatcagagatatgaaaataactaaactgtgcttatgagttttatttcatgagcttgaatttaactgtgttagtctgttcttgaattgctataaagagatacctgagactgggtaatttataaagaaaagaggtttatttggctcccagttctgcatggtttacagaaagcatagtgctggcatctgcctggcttctggtgaattctcaggcagcttataatagcagaaagcaaagggggagcaggcacctcacatgttgaaagcaggaacaagcgaaagaaagtggagtggtggggaggtgccccacacttttaaatgaccagatcatatgtgaactcacagtaagagctcacttatcgccaaggggttggcctaagccattcatgagggacccacccccatgatccaaatacctcccaccaggccccaccatcaacactggaggttacagttcaacatgagatttgggtgggggacaaatatccgaactacatcaataacctttggtatttcccagaagaagtaaaacaacatcaaatctggaaactcacaaaatcattttctagtcccctgcaatggaaaactcgatggatatccagacacgttaatataaaaatagaaatacctatgcaaagagtcaggaacattgtcaacttgaagtgaaaatgagaaaaatggctgggtgcggtggctcacgcctgtaatcctagcactttgggaggccaaggcaggtggattgcctgagctcaggagttcgagaccagcctgggcaacacggtgaaacacagtttctactaaagtacaaaaaattagccagacgtggcgggcggtgtgcgcctgtaatcccagctactcgggagactgagagaggagaatcacttgaacctgggaggcagaggttgcagtgagccgagatcatgtcattgcactccagcctgggcaacagagcgagactccatctccaaaaaaaaaaaaagaagggcagggcagggcagggcagggcagggcaggagggaggaagaaagaaaggaaagaaaggaaagaaaggaaagaaagaaagaaagaaagaaagaaagaaagaaagaaagaaagaaaggaaggaagcaagcaagcaagcaagcaagcaagcaaatgagaaaaaaaacatttctgtgaataaatgaccttcctggaaaatggaggcagacatggttgtgttttttcatccaagtgtttttgaacattgaaaagaaaacaaaatcctagctttgttaagtgtttttttgtttgttttcaatctcagacaccacttggacccagcatggttgtaggacctccttcttcaagtgctcctctctgtctccttgggcactccaggcagttgtcagataaccatctccagcttttccgtaagctgtgcttgtagcaacagggacttatctactctgattcaagagttcttgaaatcacttgtgccatgggtacctgaagcattccttgacacattttcctttcctatctttgcacttcagtggttccgttccactgcttctcgatgtctctctttacccaggcctcattcacattcacctggaggttcctgctgtccgccttctggcttgcctgcctgcttctctagctcttctcccccccagctcattctgacatgctttaccttatctcaaagtgttaagtcgttttctgcagacctttcacacagatcagagtttaggtttcttttctgttttactttttttgtttgcttacattcccaaactagcactgttctatcatatttacacttgattatgttgctcaggttccctgtaagtcaactccatgctcatcttcaatctataggaatctgtctcataattgatagtgacatctgggcaagaagcatcttaattgctgtctgttatttgcataaatcttccataaaacacaaaatgggtttttaaccttattaatgaataaacacgttagcccatacaggtgaagtgttaattgcttttctcagttaacgtcttgaatgacagcctgatacaggtgaactgtcaaatttgggcgtatctctgaaatatggcttctttacctattcaatccctcattttcaaaatgatctaacttgtcacaacagcagctttgagaattttcattcttagggacagaattatttttctagagttgagttaaatttattcaagaattttaaataaatcaaacatatatctgctgattcaatccagcacagacagatcttaaggccttggttgatggctcaggaattactaaacagcataaaattactcatttatatctttcctaacagatacatatacacacataaagacttcaaggtttgtacactagaaacctaatccccaccattacgcaatatattaatggaacaaacatgcacatgtaccgcccccccccaccaccaaatctaaaataaaataaaataacagactttgaggttttctttagatgattttaaaacaaattcatgatctcaggacacacacaaactgatgtgatggtgagacaaagcaacccaaagcatagtgcaggataaacatatctctggaggatcattcacaaagtaggttacttatgtacacataatcaaaagtttctagtaagttgttatgttcttctgtttagaatatgtgataaacatgatgcctgtcataaccattataattattagaaccttatggttagaaatgaaacatttgcactcaggtttattagccagaactaaatacattgctccaggtttcatgtgcccaaatctctcctctcacttattttggtacagtaaattgaaatgcattacatgtttcttcacttgtacttcccctaaccttttcttccccccgcccccgccccgccccgccccgcccccacccccattctgtttgtgtgcggttgattacatggccccggtacaatagcttttttatttccaaaacgcatcattgcaggcctgtagggggagctcttctacgctatgctcttgctactcaacatgtagtctggagaactgcatcatcaactgggcccttggcagaaatccagaacatctggtcccaccccagaaggaccatatcagaatttgcattttagcaagattaccattttcacatcaaagttagagaaatactgccattcatgctccaccttttccttccctttcccaactcttgctcaagggaagacaatttaagaaccaatttgactggctgctgcattagtagacagaattcttcagtgagaagagcaaataagagttacatcccacattatagtaatctctttttggatgactttctttcaatggcacacgggtaaaatggcttagccatgtgactattagattctgagtttcactcatactccatccactatcttacggaataattttgggtaggggcactgtgctaggttcttgagacagacaaaaatgaggcgaggtagtttatgaaggaaatttatgttgagacacaatatagcatagtagttaagagtgtgagctctgaagaaatactcctggattcaaagccgggttccgtaacacattagctatgtgtcttctggcaaattacttaatctttctaggcatgatggggatgataacaatagtatctacttcctgagtctgttataaaaaaaaaaagaagtagagatataaaatgtatagaaccagtgcctagcacataataattgcataaattttaaaaacctattactattattgggcattaagaaatctctgtttccaagagtgaaagtaaaaaactgaaatactcttaggaaatctttacattaagctggaaggtatgctcccaggaactggaatactaataggcaacagtttttttaaaactagatttttgggcatttttaagatggaacagccgagatactatgggtgatgatatagtttggatgtgtgttcccacccaaatctcatgtggaaatgtaatcccattgttggaggtggggcctggtgggaggtgactggatcatgggggcagatttctcaagaatggtttagcaccatccctctggtactgtcgtcatgatagtgtgtgagttcttgtgagatctggtcatttaaaagtgtgtagcacctcctccccacctcgctccttctccagccatgtgacatgcctgttcccccttcaccttccatcatctgcctgctcctccttcactttccatcatgattgttaagcttcctgaggcctccctggaatctgagcagataccattatgcttcctgtacagtctgcagaatcctgagccaactaaacctcttttctttataattacccaatctcaggcatttctttatagcaatgcaagagtggcttaattaatataggtgacatcacaaattacttatgatgctaattgattagagacaaggtatcaagtcaaagggtgagcttaagtttacaatatgtttactgccacatggaatgggttagatttgtcccaccacaagactaccaactgtagtctaagtcccaagcaaccatcttgaacgtgtgtgttgaggctcacaattggggcaggagagcatatatactcgcattactgaaaatgttaattcaaagtacatagcttagctgttgtgtgtcaatcacacctattccagtgttggtattctcatgctcctgtactctgtcaacaatatatggctaaaactacaagacatgggaagaaatgcatttggaagagaaaacacattcatgccactgagctttccatcatccaaattttaagccctatattcatcctccagaagggtggcaactccttattagtgaggaaagacagcctgcttaccaaaggtacaaaatctggtctatttgcagttctaagggtctccattctcttaaaaaatgataacccacacttctcaatttacattgtgttttaacctgatcaactttaaaatgtagaaaaagttcttcaggtctctgagttcagcattagccaactattttgtaaatctatccccatgacaagtttgggaaaagccacaagaaatcataacagcaacaaaaacctcaacccatactatgcgattacaaaaaaaaaaataatacttcagtggttttctaccaaaaatagtcttttagtaacatagttcccaacaatctacaggtataatccagaggtgtccagaatcctcaccatgtccctgaaggaggttcattttttcgcctttgccaggtcctacctgaggtcagtgtgggctcaccatactcagtcatctgttccttgctcagtttatttctccatttataagaccatttgttaatttaaatgagtcaaaacttcaccaaactctttctttaaataggaagccaacagaatcatagttgtggtggacattgtgtaacctccagctgctagaagcactgtcagaatacagcctaccactctcagccctaatttcggagagatacctcactcaagaccccatggtaacagcggggtcctggtaaatatttaagaagtggctcttcaataaaataaacaaacaagcccagattgatcgatttccaatttctgtgatgtaaatactccctacattgccgatttcaagatactgacatgactgacttcactgaatgcagaatgggaattgatgcacacagtcagctcatgggagctggtatgagctagctccagcaaaccatgcgtggtggcccatatccaaagactgattatgtgggagtagaaaaagactgattatgtgggagtagaatggcctggtgaactcaggacaacttggaagggacattcccggggttaggtcagctgaggctgttgtcaggttagcattcacagttcaaccttcccatctacctaaccctgcttcctttctcctcccttacacagggattggtcccaagaacacgcctggccaacatagtgaaaccccgtctccactaaaaatacaaagaattagccaggcgtggtggcaggcacctgtaattccagctacttgggaggcagaggcaggagaatcacttgaacctgggaggcagaggttgcagtgagccgagatcgtgccactgcactccagcctgggcaacaagagtgaaactccatctcaaaaaaaaaaacaaaaaacaaaaaacaaataacaaaacaaaacaaaaaaacacatcctatatgctaaattctgtgtgcttcctggggaacccaacctatgaaaatttatactttttaaatctccatgtgtgctgccagtgatcctctactgttctaaagaagagccctcacatgattttatactttttgcaaaccagataatccaatttaattattaatacgaggacaccacatttgtataaaagacaattggaattacacttacagatttttttttagaaactaacagaaaccttcataggacataacaacactctctaaagtctgagtctcttttgagattcccgaggcagaggtaacatttctaggataccttctacaatgcaaaatactgtctgcctttctgcaactgcacacaagaaggaacaattttcctttttctcttgtgataaaatgtatttcataagcagttagaagggcctgctatgtcaaggctgaccactgatgttcacaaataaacatcataaataaaaaaatcaggttatagtagcccaatacttacaatatgaaaagaaagagcagaaaaataattttaaaatataggctgtgggtcatgtaatgctatgcaccggcactttgattctgttcacaagactctcttgggtctggcattgtttgcttctatgtccatgttacctttgaggacacagattactccattcccaggaaactccttgagattgtctaaggcgctctctatttcggcttactctgtagccacttgtacttctatgtcactcttgtgcatgcaggagtcattttggaaattctatgtagccgctcctctagcaccaaacaaactccaaaggtctacacacaacccacagccacttatactgttgtgaattgctgccccaggaggacccacgaggcacaaggactaccagattcatagattcccttaggtttgttcccagttccactcatcctctactccactcaatcacactgttataaatggagctgtctgcagaacatgagggcgtgaaacagcattgagaggaaaaaagctggaagactagctgagctcagagggcacctacggtgaaattcataaagtaaaacaacaatgagttacccctccccaaatcgtgttagtaatggcgttaatatttgcaggggacccaaagggtgtctggtacatcactcattgagactgtcacccaggaacgaatgtctttaaggaacatatcagatatatggggcacaggcaataactttcttctttactctgtcagcatgtgtgtgtgtaaaatgattgatatggtttggctgtgtctcacccaaatctcgtcttgaattgcagttcccataatccccacgtgttgtgggagggaccaggtggaaggtaattgaatcatgggggcggttaccctcatgctgttcttgtgatagtgagtgaattctcacaagacctgatggttttataaggggttttccccaccttcatgctcatttctctctcctgccaccatgcaaagaaggacatgttgcttccctttccaccatgattgtaagtttcctgtggcctctccagccctgtggaactgtgagtcaattacacctctttcctttataaattacccagtctcgtgcagttctttatagcagtatgagaacagactaacacaatgatgtacctaaaatgaaggttaaaaaatcagggggtggaggcagaaaggaacactcgggacaataattcagactgttggaatgaccgcaatgcccttctcctcagctccaagtttaattgctgctttcttcaggattttccagaaagcacttacccattcttcttcactctgaaaatgaactccactctctttgcgcctctcttaagacaagtaagcccctatcatacacgagtttacatcattttgcccttactcaacgatacatttttcaagggcagcattcatatctgattcacagatctcagttccttcagctagtatcttgcatgccatgtaagtaaccagtgtatatctctgaagaaatgcagcaatgacagtagtaatttgggtctgatcacaatgcagctttcaggagctttctcatgactaggcttaaagtgcttttcttctgtaagatctaagcatcggagtgtaatgcctcctcgctgttttaaagtgaaattggtcattagaaatgaaattaggatcacaaataatttgtaaaagtctcttctagggcaggaaagaatgtaaatctaatgcccagtagcctaattaggctttgaaatgttattggtatatgaaacccaagtgcttgtaagcaccgatctagaacatcaaatgtggtttgaatatttttgttccccaaaatttgtatgttgaaatcctaaccccgaaggtgatggtgttagaagatggggcctttgggaggtgactaggtcatgagaggacaaccctcatgaatgggattagcttgcccttataaaacaggcctgagagagaccccatgccttttctgccatgtgaggttacaatgaaaagacagccatcagtgaaccaggaagcgggcccttaccagacaccaagtctgttggtaacttgattttggactttccaggctccagagctgtgagaaataaatttctgttgtttataggccacccagtctatggtgttttgttatagcagtgtgaccagactaaaacaatttgcaaacgaacccagattagaatgcttttaggtgtgaatcatggttgcaggcaagaagggctgaagggaggttggagaggctggagagttgaggcaaagacctataatggaggtaggtctgatctgatactataggaggtaagaaattagagatagaaggatgttaaagtttcaggacaaaaaaaccaatgtggcttttgggaagaaatcagggcagcctggaggactaggacaaaaaattcaggttaaggatacaagggaaatggagaaggatggtttgggtcagtttgagttctagacttctgacatggattaatttattgacttggttaacaatgatggaaaactaaaagaagtatctgcacattaaataacttgataaagaatgcatttaatttcatgattatctactttcagaaagcaaaaagaaaggattctactaataagaatggcaatagaaaccatgtgttcatctgttttgagcacctacaatatgcgatattatgagaaagaactggctgaataaacaaaaatgaagaaatgctttatgtgccaggcaatctacatattagctgattaactatcaagagaaagttatattagtttatatactaacataaacattacattgtagacaacatgacctaggcttataaaataagagtttgccaagagaaaggcagactggattactaaggaatcttctctgttgccctctctctagacaggtgtttgcttatagtaggcctgcctcatagggtaatagttgcttatagtaagcctgcctctacattgtacttgggagctgccatgcaattcctacagaaactgtccagcactacagtttcaccttgtgtaactggcataaattgattctagataaataaattagatacagcacagctgtgtgtggataacggaaagatatgaggatgtaacgatatatacccttatagtgtatttggatcaaaaccaataaattaattcacattcagcctataaccataagcacactaacaggactacaatagcgagtagaaaaggtgacaatactcctacgtacaattaatgtaccatgttatgaagcattttaagaccacttttctaattgtcttttatctttatcccatgcatggtttccctccagttctccagtttgtttttgttcaggcttggccacagctgctcctgcttataccatgctgctttctaaaattttagctatcatcaccaatttcacacacttctactatttattgcctagatacgaaagcagttcttcatttttatttcaaggtaccccgattttctgtctcttcctgcagtagccttgggaagggtgattctgatgcaaatgtgttgagtcattgtggggattcagtgaggtaacaatgcttttgactgtcactgaggcatttaacaaatggtagtctcccctcccacatccccattttcctgttatataaattatagttattattacagtatctggccctgactagtctcacctcactcctgcagaacaaaattctttggtgaacaaattatttctgtttaactggttgcacccacctaacagtgcaacacctaaactcaacagttttgcattgcatctgcaatgttcaacagtctataaatcactttcttatgcactgttcatttgcatctcataacaactctatgaggtaggtaataatagtaagggaaactgaggtacagagacattagaggcttacttaaggtcaactatccaattagcgaaagagctggaagatgctgttttcctgcttcttgactgttctttccataagactataatgtttcccaaagaaatgcttgctaacgattctttgaaaattaaaatacacataatatatacaaaatcacctgattcaccaagtctatctatattgggcacggggatccctgttctcagcttgtaagtgtccattgtgtgaaagactggtatgacatttagtgtaaacctaatttaaaaaaaaacaatacatctaaatacttctcagtcagaaacagccaggcaacagctcccttgacccaaagccaacttcaagagccaatttttcccaaacgacagaaaggcaggatagagcagccataattatttctatgagataatcctaccacctcaggtcttctaaggtgcaagtgaatgcacttaattgctcagctgtgtatttgcttgaatgtaatcaaccacttactgggagttgctgtctaactattaggatattggcacaagaaaagctaaataaattagagagagttcactctttataaagctgcttttggaaggaaagtgtcttccatgttcagagccagggggagttggaaaggaacaaggttggaagtcaggctgcagtcataacaaaatgcttactccttgcgagcgttgccccattccctgttaacacaggacatggcccaaagccgctgacctctgtagagtgctcttctgtcattctggagtgatggccagtcttattaaatgcacctattacccgcagagcgagcaccagcatgaaatgagttgtgcttgatgagcaaggaggacaagaagcttgcttttttagcatgaataacatctgttccttcaagcatgaatacagcagcaaggggaggagatgaccagacaaggcagaaaaacaaacagcatgatgtttggtctccagggtaattaccttgatatctgggtgtttgtcttttgtccacagggccttgtgcagcttgagcacactctgcccaagggctgtagctatgagaaaggctctcagtccatgagctgttacagtgaagggtctgtgggcccatttaaaaaataataaaaggctaactgcattttctttcaagaagagacttctgagaaaagactggaaggagaggttacttcaggtagtagacacatttaaaggaaaggctctaaatgtgaaatgatggctcttctaagattaaaagaccactgctgtggttttattcttagatcttaagtggctctttaatattttgaacgttctatcaaacgcaaccttctttcacctattgtcccagcctccagttcatctctattttatcctgtccaccactctagaacttaaagtactattttgtttgttggctatttgcttgcttgtttgtttgcttggttatttattggcctggttgcttgcttccttgagtgtttgcattgagaattctatcagtattttaaaaaccatcatttgtatgtatcacaatatgtcataaaatacatttttttttttgctcaacaatgtgctaatcctttttgcttttgcaatcaattttattctttcagcttggcaaataaaatgtcctctattcatttgctcacatcctcttctcttcaatccaaccacttgtttcctgatgggttctattcaagaacctcacttttatgtttcttgctgttttctaccctcaagaagtaccacttataatttgggggtcggagggggcaatgaaaactgaaaatgtggaagcccttgttcaaaaagcagtaaaaagtttcattaagtgtactaaaatataaacctttgtctttcttctgcagtctctctcaacttctcatggtgttttaaatctatttgatgttcttctgagtaatgcaaaatcaaaaattttaatcattcccgtatattttaacattcatttttatattgtgcaatgccagttttaaatggaaatataggaacattttacttgtttacaaaatcacagttcatatttcatagctcatacatgcatatgtatttcacaagtttttgtttaccttcttgatatgaccacatgtaccaacactccctaccttcaacttaataatgggtaacgaaagactgaaaggaaaagaaattatggattaccctatcttttccctttacttcaatatcatctttttcagtgtaagtggttggctaatatggggaagtaacaggagtaagaatggatacgacagggtttctcagttctacatgtttcttagaatgcccttatcctcttgctgcgtgtctgaagcaagttcctgttggaatgaaaaatgtgccctctccaggatgtcagcagtccctcactttcctgcttactcagtcatagaagtaacacatttatcttatacttgatttatgtctcactgaactcccctacatcatgagaccactggaattctgtgttcataggagcatctctaatgctaatatgtgagcagggcagcaaggagtgggggacacacatattgcacatgtctcctctgctcattcatgctcccttgtcccctaggacttcacttataaaacacaagttcaaggataaaattattaagaatgtcaagggagggaggttccaagatggccgaataggaacagctccagtctacagctcccagcgtggacaacgcagaatacgggtgatttctgcatttccaactgaggtaccaggttcatctcactggggcttgtcggacagtgggtgcagcccatggagcaggtcggatcattgcctcatctgggaagtgcaaggggtaggggaattccctttcctagccaagggaagctatgacagacggtaccaggaaaatcaggacactcccaccctaatactgcacttttccaatggtcttagcaaatggcacaccaggagattacatcccgcacctggcttggagggccccaagcccacgaagcctcactcactgctagcacagcggtccaagattgaactgcaaggtggcagcaaggctgggggaggggcatccgccattgctgaggcttaagtaggtaaacaaagcagcccgggaagctcaaactgggtggagcccaccacagctcaaggaggcctgcctgcctctgtatactccacattctggggacagggcatagctaaacaaaaggcagtagaaacttctgcagacttaaacgtccctgtctgacagctttgaagagagtagtggttctcctagcatggactttgagatctgagaatggacagactgcctcctcaagtgggtccctgacacccaagtagcctaattgggagacatctcccagtaggggctgactgacacctcatacagccgggtgcccctctgagacgaagcttccagaggaaggctcaggcagcaatatttgccattctgcaatatttgctgttctgcagcctccactggtgacacccaggcaaacagcgtctggagtggacctccagcaaactcccaacagacctgcagctgagggtcctgactgctagaaggaaaactaacaaacagaaaggacatccacaccaaaaccccatctgtacgtcaccatcatcaaagaccaaaggtagataaaaccacaaagatggggagaaaccagagcagaaaagctgaaaattctaaaaatcagagcacctcttctcctccaaaggagtgcagctcctcgccagcaacggaacaaagctgggcagagagttattttgatgagttgagagaagaaggcttcagacgatcggtaataacaaacttctccaagctaaaggaggatgttcgaacccatcacaaagaagctaaaaaccttgaaaaaagatgagacgaatggctaactagaataaacagtgtagagaagcccttaaatgacctgatggagctgaaaaccatggcacaagaactacatgatgcatgcacaagcttcgatagctgattcgatcaagtggaagaaagggtatcagtgatggaagatcaaatgaatgaaatgaaacgagaagggaagtttagagaaaaaagagtaaaaagaaatgaacaaagctaccaagaaatatgggactatgtgaaaagaccaaatctacgtctgattggtgtacctgaaagtgacggggagaatggaaccaagttggaaaacactctgcaggatattatccaggaggacttccccaaccgagcaaggaaggccaacattcaaattcaggaaatacagagaacgccacaaagatactcctcgagaagagcaactccgagacacataattgtcagattcaccaaagttgaaatgaaggaaaaaatgttaagggcagccagagagaaaggtcaggttacccacaaagggaagcccgtcagactaacagcggatctctcagcagaaactccacaagccagaagagagtgcgggccaatattcaacattcttaaacaaaagaattttcaacccagaatttcatctgcagccaaactaagtgaaggagaaataaaatcctttacagacaaacaaatgctgagagattttgtcaccaccaggcctgacttacaagggctcctgaaggaagcactaaacatggaaagaacaaccggtaccagccactgcaaaaacatgccaaattgtaaagaccatcgaggctaggaagaaactgcatcaactaacgagcaaaataaccagctaacatcataatgacaggatcaaattcacacataacaatattaaccttaaatgtaaatgggctaaatgctccaattaaaagacacagactggcaaattggataaagagtcaagacccatcagtatgctgtattcaggagacccatctcacatgcagagacacacataggctcaaaataaagggatggaggaagatctaccaagcaaatggaaaacaaaaaaaagcaggggttgcaatcctagtctctgataaaacagactttaaaccaacaaagatcaagagagacaaagaaggccattacataatggtaaagggatcaattcaacaagaagagctaactatcctaaatatatatgcacccaatacaagagcacccagattcataaagcaagcctgtagagatctacaaagagacttagactaccacacaataacaactggagacttcaacaccccactgtcaacattagacagatcaatgagacagaaggttaacaaggatatctaggaattgaactcagctctgcaccaagtggacctaatagacatctacagaactctccaccccacatcaacagaatatacattcttctcagcaccacatcgcacttattccaaaattgaccacatagttggaagtaaagcactcctcagcaaatgtaaaagaacggaaattataacaaactgtctctcagaccacagtgcattcaaactagaactcaggattaagaaactcactcaaaaccactcaactacatggaaactgaacaacctgctcctgaatgactactgggtacataacgaaatgaagacagaaataaagatgttctttgaaaccagcgagaacaaagacacaacataccagaatctctgggacacatttaaagcagtgtgtagagggaaattcatagcactaaatgcccacaagagaaagcaggatagatctaaaattgacaccctaacatcacaattaaaagaactagagaagcaagagcaaacacattcaaaagctagcagaaggcaagaaataagatcagagcagaactgaaggagatagagacacaaaaaacccttcaaaaaatcaatgaatccaggagctggttttttgaaaggatcaacaaaattgataggccgctagcaagactaataaagaagaaaagagagaagaatcaaatagacacaataaaaaatgataaaggggatatcaccaccgatcccacagaaatacaaactaccatcagagaatagtatagacacctctatgcaaataaactagaaaatctagaacaaatggataaattcctcgacacatacaccctcccaagatgaaaacaggaagaagttgaatccctgaatagaccaataacaggctctgaaattgaggcaataattaatagcctaccaaccaaaaaaagtccaggaccagatggattcacagccgaattctaccagaggtacaaagaggagctggtaccattctttctgaaactattccagtcaatagaaaaagacagaatccttcctaactcattttatgaggccagcatcatcctgatacaaaagcgtggcagaaacacaacaaaaaaagagaattttagaccaatatccctgatgaacattgatgcaaaaatcctcaataaaatactggcaaaccgaatccagcagcacatcaaaaagcttacccacagcaatgaagttgacttcatctctgggatgcaaggctggttcaacatatgcaaatcaataaatgtaatccagcatgtaaacagaaccaaagacaaaaaccacatgattatctcaatagatgcagaaaaggcctttgacaaaattcaacagcccttcatgctaaaaactctcaagaaactaggtattgatgggacgtatctcaaaataataagagctatttatgacaaacccacagccaatatcatactgaatgggcaaaaactggaagcattccctttggaaactggcacaagacagggatgccctctctcaccattcctattcaacatagtgttggaagttctggccagggcaatcaggcaggagaaggaaataaagggtattcaattaggaaaagaggaagtcaaattgtccctgtttgtggttgacatgattgtatacttagagaaccccatcatctcagcccaaaatctccttaagctgataagcaacttcagaaaagtctcaggatacaaaatcaatgtgcaaaaatcacaagcattcctatacaccaataacagacaaacagagagccaaatcatgagtgaactcccattcacaattgcttcaaagagaataaagtacctaggaatccaacttacaagggatgtgaaggacctcttcaaggagaactacaaaccactgctcagcaaaataaaagaggacacaaacaaatggaagaacattccatactcatggataggaagaatcaatatcatgaaaacggccatactgcccaaggtaatttttagattcaatgccatccccatcaagctatcaatgactttctttacagaattggaaaaaactactttaaagttcttatggaaccaaaaaagagcctgcattgccaagacaatcctaagccaaaagaacaaagctggaggcatcacgctacctgacttccaactatactacaaggctacagtaaccaaaacagcatgatacgggtaccaaaacagagatatagaccaatggaacagaacagagccctcagaaataataccagacatctacaaccatctgatctctgacaaaccagacaaaaacaagaaatggggaaaggattccctatttaataaatggtgctaggaaaactggctagccatatgtaggaagctgaaactggatcccttccttacaccttatacagaagttaattcaagacggattaaagacgtaaatcttagacctaaaaccataaaaaccctagaagaaaatctaggcaataccattcaggacataggcatgggcaaggacttcatgtctaagacaccaaaagcaatggcaacaaaacccaaaattgacaaatgggatctaattaaactaaagagcttctgcacagcaaaagaaaccaccatcagagtgaacaggcgacctacagaatgggagaaaatttttacaatctacccacctgacaaagggctaatatccagaatctacaaagaacttaaacaaatttacaagaaaaaatcaaacaaccccatcaaaaagtgggcaaaggatatgaacagacacttctcaaaagaagacatttatgcagccaacagacacatgaaaaaatgctcatcaccactggccatcagagaaatgcaaatcaaaaccacaatgagataccatctcacaccagttagaatggtgatcattaaaaagtcaggaaacaacaggtgctggagaggatgtggagaaataggaacactttcacactgttggtgggactgtaaactagttcaatcattgtggaagacagtgtggcgattcctcaaggatctagaactagaaatatcatttgacccagccatcccattactgggtatatacccaaaggattataaatcttgctgctatatagacacatgcatacgtatgtttattgcggctgtattcacaatagcaaagacttggaaacaacccaagtgtccatcaatgatagactggattaagaaaatgtggcggccgggcgcggtggctcacgcctgtaatcccagcactttgggaggccgagtcgggcagatcacgaggtcaggagatcgagaccatcctggctaacacggtgaaaccccgtctctactaaaaatacaaaaaaaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaagaaagaaaatgtggcacaaatacaccatggaatactatgcagccataaaaaaggatgagttaatatcctttatagggacacggatgaagctggaagccatcattctgagcaaactatcgcaaggacagaaaaccacacaccgcatgttctcactcacaggtgggaactaaacaataacaacacttggacaaagcatagggagcatcacacaccggggcctgtcgtggggtgggggaagggggaagggatagcattaggagatatacctaatgtaaatgacgagttgatgggtgcagcataccaacatggcacatgtgtacatatgtaaaaaacctgcacgttgtacacatgtacactagaacttaaagtataataaaataaataaataagaatttcaagttggtgataacagagcattaaaccaaaggtaaggcccttctgagtttggggccttgtgtgactgtacaggttgcatgcccatgaaatcagacctgcccttaagtccatgatgatgtcttcacatcagagtgcccagtttaggtcatcaaagaaaattttttttctcttcagtgaagggaaggcagttgagatcaatgacagggtaacgttagtgagggcaggaaccacacatcaccttacactttatctatttgttgaatagacaaaaaagtgactacagttggacagaaagaaaatgacagaaagaaaagaaaagaaaacagaagaaaagaaaaaaaagaaaacagaagagaaggcaagaaaagaagaaaagaaaagaaaaaagaaaaaaagaaaaagaaaaaaagaaaagagctaccgtaacttttttggagtgaagtgattaagagcaccaattctagagccaggctgcctgggttcccatcttcgttctatcaaatactagttgtgccaccttgggtaagttacataacttctcttggcctcagtttacttatttgtgaaatggggatggtgagaatagtatgtgcctcgtagggtgagtatcgaatgagtcaatgcatgtgaagtgtttagaagagtgcctggcacatattaagcattatggaagcaagtgacaagtcatattctttccagaagtttcttatttacttctcacaaggctaagagccatgcatttgtatatccgtttaacatatgaggaaaataaggctcaggtaaatgatatgatgatgtaatttgctaagtttacagagctagtaaaatacgagaattttaacttggactatatcctgaacttacatgtcaacaccatctcctggtataaccttacggtattcctcttgtttcccaaaataaacttatttttcatatactatacagtgtctatagcatgcctcaatttatatactggtaggtttctgaaaaaagtgacaaataaatttgtactactctagccgtttaaaatataaagtaaactacttttatggaatcaaatggttaatgcttttgtgggttaaatgataacctcactaaatttttgagttgtaattttttattagcatttcttcgaaatggatatcactcctattagtatgttgttggagatagctgacgtttttctgttaatgtctcggaatttctttgattctcaaaagaaacaccgtgagataaaccaaggactcccgtaaatcaccaagagacaacctagtaaaatagaacccttttattgagaaagaacataagtttagggataataggacgcggtatttgggatcaaacagcattagatatctggctgcccatctcctcagcctgacgaaaatgtgatatcttgccagaatcataatctcccaaagatgggatcagctgtatattatcattaataagctaattattttatggaggcaaacatgaaaatatttttaaggtatttcataaattcaatcccagtcttgatgtctgatttctattttcccaaaagtgctctttatctgggtacttcccttccatagaggtgttggtctcaaggtctaacctgataattgaagagcaacttactgacattatagagtattaagtgaaaaaaagcaagatggcaaacaacatatccagtgtgatctaattttggtaaaataggagctatagatatagatagaagctattctagaagaatatgtaataaaaggctaatagtgacataatcgaagttgtagaaataaaatgcctttgttttcttattttttgtgttctcaaattttctaaaatgcatatatactgcttttgtaatgagcagtcctagctcaaaacttacaaggaagtgtttttgtacacacacacacacacacacacacacacgtcattcatttatctgtgacagaataggcaaatgcatagagacagaaagtagattagtgattgccaggggctggaggaatagcaaatggggagtgagtgctaatgggtacaagggtttcttttgggggtgatgaaaatgttttaaaattagcttgtggcaatgattgcacaactccaaatacgctaaaaaaaacacttaattatctactttaaatgggtgaatcatatggtatatgaaatatatctcaataaagctgtaaaagtatctatgacatgtttttcttaatgacagatcaactctccttcaaatcaacatgcttcttgttcaatcccaagctgctaggaacttgaagaatacacactggggttggccgaatggtctttatgagctcttctgtttccaaaattcctaatattagtctaaaataaaaattgcttctcagaaaatcaaaggatattttccaaaataaacagatatttgtagattgtctagtgtcgcctcatagaaagagtaaagataactcaggagttctgagttcctctactgactgctactcccaatctgggtgacctttggcaagtcattccacctcctgggctttgtttttctatatgtaaaatggacagattggaccacatgactgcccgggtttctttcaatttgagttttgtgattttatatggtcaggtgtttgacgatttttggaaattagattaactttctaaaacatcactactgagttctttctaaataaaatatttttgaaaagtttaatccttattttccagtgttaaatgacctcacatacaccccagtaagtaagcaaaatggctaaaacatgattcaatccaaatattgaggctgggaatagtgaaaaaaaaaaaaaaagtgtgtgtgtgtgtgtgtgtgtgtgtgtgtttcttggtttcaagcatgaatgctctggcacctctccagaaaacatccatctgctttttacctaatggcaaggacttccaaaccaagctgcaatttttatgcctttcctccaaaaaaaacaggaagcagcagccagctcagcggtgctaacctccaatggccagtactgttgtttgtgatcacgggcagctgaaagccaaggctgcagaagctgcaggagatgtcagttctgacacgtgggtccccgtggtgcccagagcctgcactggctgacgcaagccttgcaggtgcacttggttaggaaggcagaacctggactctcagaagcagtccatgttttcaagccccctccagggaccccgaggcggaggggctgagacaaggatagagatggaaactctgtagaaaaccaggggtaaacaagaagacttttctgacatttttgcttgagggctcaatattttgaatagcttcaacatttccgaaataagatttctatgttctcatgccagggcttttaaatgtttcaagcaaaagtgaatggattatgagattgagttcatgatgattagagggttaagggagcactgtcaaagaatggaaagctaacactaaaacaagccaaactataattgtaggacatttgattcttttctttgtgatctctccatctcccgttgttggtacttctaattaaagctatttccaataaaaataaaagaggtcacgcttgctcatgttgctccctcttcagtactctacttggtttgtgactttaacatagtctagtaaattctaattactgtcccttttccctcccgtaacaagctctccttttttgaaaataattcgtgatggcagcagctctggtagggtgttggctaggctgctgaattcaatatctaggcctgctagagcaaggcacaaagcattcagggatatggagctgcagacaagaaaatttaaatattttgaggtttttaaaaatagaatagagatagttactatattaaagttcaaaggccgatctctgtaatggtcccaattggttgaaattattttacttctttctttaattgtatacatttaaggtatacaccatgatgtactgaagtacatataatagtgaagaggtttctacagtcaaggaaattaatatatccatcatctcacataggtacctttctttttctttttgtggtaaaagtacctgaaatctgctatcttagcaaattttctgtatacaatacaatattattaacgatagacttttagacttattcatcctccataacgataactttgtaccccttgacccacatttctccattttttccatcccaccgccaccctcatccctgcatctggtaatcattgtcctactctccgtttctatgtatttgattttttttttttttttcagaatcatgacatcatgcagtatttttacttttgtgtctggcttacttcatgtagcataatgtcccctaggttcatccatgctgtcaaaaatggtaggacctccatttttaagctaaatagtattctatgccacaaatcctttatccattcattcgtggatggacacttaagttgcttccatatcttggctattgtgaataatgctgcaataaacataggaatgcatatttttataggatggtgatttcgtttcctttgggtacaaacacaggagagggattactgggttatgtggtagttctattttcaatttctttaggaacctccagtactgttttccacaatggctgtaccaatctacattcccattaacagtggacaagggttcccttttctccataccttcgaccacaatggttatcttttgtccttgggataaatgccatccaaatggatgtgaggtgatatttcactgtggttttgatttgcaattagcaaatgttgagcacctgattagccatgttgagcagcttttcatatacctgttggccatttttatgtcttcttcgttttttgttatttatttatttttattggataaatatttattcaggtcatttgcccatttttaaattggattatctggttttgtttttgttttttgttgttgaattctatgagtttcttatatattttgaatattaacatcttgtcagatacatggttctcaaatatttttctcccagtctgtacactgtttttttgtttgtttgtgttattgattgtttcctttgctgtgcagaaactttttagtttgatgtagtcccacttgtttatttttgcttttgttgcctgtacttttggtgtcctatgcttacttcttttaaaaagggagagaataagttcaaactttactgaatcatcctttcttttggtcaaatgtacatataaacttctcactttgcttctgtgtgcctactgctagttgtatagaacggaaacatagttcagaagaatatcacagagtaacgttcgtgggctcaaagaatcggcaggcagatttctggttaaagaggtagtaatgtcttatagaaaaataccgaaattatttctttggctgattagctgtatattttgacaccctggtggtcactgtgtttagagaactactcttactagttctacaaaaagagataaagatggaaagtaccatttggaatatactgtattattgttcacagctattcagagaccctacctataccatcaactatctgttgaactcgggcatgaccggataagttcctttgaccagtaaaatatgagcagaagtgacatgtatcacttagcgacagaactttaagagtcaggacataattctccagtttcttttatgcctccttctaggattacggaagcaagtatctggaattatcagcctggatcagtgagaaaacatgagcagagccccagtgctgatctgcaatagacatgaaatgtgagtgagaaataaacattgttctattaagctgctgctatttgggagttgtcttgttacaaaaccataacctatttttttatgaccaatacattaaccttgcccttgaaatttttaactactatagtaggtaggacaaatacacatatctgtgcttatataaatgatacatacaaattcaaatcccacctagtacagaaatatagatggaactgttgaaagaggaaggataagaaggaaacatgtatcagggaagaaaaacctctagatgacctagactcaggtgaagttactttagaaagttctgtaaatgaactttgaagaaacttctggagaagaaaagctaagtgaatcatgggagaggctcctccaaggaggtgttattttgtggaagcacatagacataacaacagtaagaatgtcaggaacttactcaccaggtcattcccatccctccctcccccaccccttcagatctaaggattctttctgttccactcagtagtggtcatgtcttctcaatttacatactgttcaattttaaccagattgctgtcttagaaaaaagtaaaacttttgtatacttaaggagaggtgttcattcaattagcaaaattgtgcatctctaggcataatccaaagtacggaatgaaatatctaaagatgatgctcatcagcaaagaaaacaggcaagaatgctgatctacttgacggcttcactttgggggttggcttttgcactctaatgctggaagtttctcagcccatgttgctctatcacgtttcctcatctatattccagaaactttcattttactctattatatcattcagccctactttattttctcacttttaaattcacaattaaaatgaaaagcaaaggcatgtgtatttgccagtttctctgcggttcttagagccctaattatgatatgaaaacatgatttccaactttgcagatgatgctaaattgagagagaataaaaacaaatgacgaataattaggtggtgcagccagatataaaaggatttacatcatttatgtttctggactaatagatggcaaatgcagggctgcacagataaatggaagataattagcccccgcaaagtaccagaaatggggatctctgctaaataggaaggtgctgacgaaaagtggcgtgagtgaggagaaacagtggggtgagggtgtcagcgagggtgattacaggctgaggatgattgcatcatggaaaaactccagagatctggcacgttctccagctacccttttagtttgtatccctccctcactctgtcacacagaagcattctgttgttaacagtgtatttctttaaagctttatatacagcctggctctgtgcagtccttgcattgcaggcaggctaggaaaaggataacttcagagggaggacattttcttcaaccagggaattttacctgggagtacattatggcacaaaattacctaatcattttgaaaggcatattttggtggattaagactaaagtgcctccatgacttcgcagagatgcaaagaaaatgcatatatgttgtcaggagttgtttaattcttgtgccaggagccccttttctccaatggtccccagtgctctctgagggtgcctcacacttctttcggctcaaggttttatccctggacctgagaaggtaacccagctaatcatccaatcctttccatttgcaagtactctaggtttggttactgtagatctcccagtgacaattatacattgcccgaggttccaaaacagtagaacaaaaacagatcaaatagcagaaatgggtgtatgcacctccaaggtcaaagtctggctagccatcaagctgagctgttctccatcctccactgctcttgaccttttcatgatattaggcatcatttatcaaccattagtgcatctttctaatttttagcttccatgatactatatgatgcctacctattccattctttctttctcactctcttttccctcctcaccctcttatgatagacactcctcaaaatccagccttctacctttacacagttctctttctatactgtttcatagactgtatctattctcttggttccagctatatcataccactatgttatacttcaagattcaattctaattatttttgaaccatgaatcttttctgttcttccccaaatgatttcttgttgccttaaacttctctgatactcaagtctataagtttataagccagtctaatacttaaaatacataaaatatatcattgcaataaaagaaaatcttggagatatgacaattgaaagactatccttcttctgtcaatttaatatgtaaacaaacaggttcctgctccaggggtgataactgcttcttagagcttagctcccataccccaatccagaagtcctttatggacaggggattgagctcttccaacctctttctgctgtccttccaccagtttccatatgccgctactaagagtgatacattttgactgtctctatccccatctatctccaatccttagtcagagttcagttacacttttttttctcagttggtaatttatttttatctctactactgtcttagcagatcaactatttggtttggttccttgaggacaagtctctaccacagctaatcaaagtagcccagccttctgttgtccccactgcctaaggccagctaattctgaagcacctcaaagttctctaccttcccctttccaatgccactactggtactctcaccattggcaccactactgctcctattcctcccagagatggtaaaaacacatcatttacttaatattttgtgtgtggaatagcagaacacacacacacacacacaccaccttgtcactaccagcttcaccaaaaatccaacccaaaacaacagttgcaagacatacattggaatactgtcacctctattcgcactcagccccagcccctcagattattgacaaaacaatggatcccttatgtcataaaaataaaacttatgtttgtctctatagaggaaggggctgactaacacaagcagttcagctgtcagcaaagaaaggcaaaggaaatgcttttcctctcaaatctgcagcacaatgaatgtggggactgcaatgggtctaacgtagacttcaggtacctcttgggcagactgttttcagatttgaaagcatgggcctatttttatactcactcaaactgtctgtcgtagcaagaggggaaatgtccttccttcgtggactggagtcccagagttcctaggcatatacagataaccagagaacctatacttagaatggatctaaatctctgggctcctggaatggtgccttgcattagagttgtttgagaatgagtcttatcttcccaagttctttgtcgggtactaggaaccgggatgctgtattatatatttaatacacttgtctgctgttaggtcaagttctttttttgtgtgtgtgagatggagtttcactcttgttgcccgggctggagtgcaatggcgcaatctcagctcactgcaacttctgcctcccaggttcgtgattctcctgcctcagcctcccaagtagctgagattataggcacgcaccatcacgcctggctatttttttgtatttttagtagagatggggtttcaccatgttggtaaggctggtctcgaactctttacctcacgtgatccacccaccttggcctcccaaagtgctgggattacaggaatgagccaccatgcctggcctaggtcaagttcttttcttttcttttctttttttttttttttttttgagacggagtctcgctctattgcccaggctggagtgcaatggtacggtctcagctcactgcaacctctgcctcccgggttcaagtgattctcctgcctcaggcaccggagtagctgggattacaggcttccgccaccacgcccagctaatttttgcatttttagtagaaatggggcttcaccatgttggtcaggctgatctcgaactcctgacctcaggtggtccacccacctcggcctcccaaagtgctgtgattacaggcgtgagccatagcgcctatattcggtcaagttcttaaagttactataaagagcattaggctcagacgctctgggctggcattctactaataggatgtgcctgctttcatttatttttctactaatttttatcatgacaattttcaaacatacaaaagcataataaccatatcgatttccatgtatcaatcatccagcttcaatatttatcaacaatttaccaatcctatctcatcgatagatgctattttcccttgtacttaaatattgtgaagcagatcgaacacatcagaagtatgcatctctaacaatccttttaaaaatcaggatttaattattgaaatataatttatgtaaagtgtatcaattttagtaagaatgttttctttttaatttttaatttatttatactaattatacacatttatggggtacataatgatgtttccatacatataatgtatagtgatcagatcagggtaattagcatagccatcatctcaagcatttattatttctttgtattgggaacatttaatatccttcttccagctattttaaactatatattactgttaactatagtcatccctacagtggtataaaacactagaatttatttcccctatctggagtgttttttaaaccactttatttttttaacttttattttaagttcaggggtacatgtgtgggtttgttacataggtaaatgtgtgtcgtggagatttgttgtacagattattttatcacccaagtattaagtccattagttatttttcctaatcctctccctccttccaccctccaccttttcaataggcctcagtgggtgttgttcccttctatgtgtccatgtgttctcgtcatttagtaaaccactttattaaggtctgattgagatacaaacagttgtacattttaaatgtgtacaacttgatgagtttggagataagtacacaccgctggaaccattaccacaatcaaggccataaatatatccatcacctctaaaagcttcctctgctacatttatttatccattcattctttcatttatgtgtgtatgcatgtacgtatgtatgtatgtgtagatggtaagaacaatgaagatctcctctcttagcaaaattctaagtatacactacaatatcacttactacaggcactacgctatagagtagatctccaaaatttattcatcttatataactgagactttgtcatctttgttcaatatttcctaatttcccccttcccctccctctggcaaccacctttctactctgctgctatgagttcgactattcaagatgccttatataagcaggataatgaagtatttgtctgtttgtgtatggcatatttcacatagcataatgtcctaccagttcatccatgctgttgcaagtagcaggatttcttttgttttaaaggctgaataatattccattgtgtatgtgtatactacattttctttatccattcatctaataatgggtatttagtggattccatatcttggctattgtaaataatgctgcaatgaacatgagagtgcagaaaaagaaataaaggccatttaaatctgaaagacagaagcgaaattatctctgcttgaagataatattaccttatatatagatctctctgaaaactccaccaaaagaccctgttagaacaaacaaatttagtaaagttgcaagatacaaaatcagtatacaaaaatcagttgtgtttctgtatgctaataatgaactattctaaaggaaaattaaggaagtactccgatttacaacagcatcaaaaagaataaaacacctgggaatcatctaaaccaaggaggtgaaaagcttaaacactgaaaactacaaaacattggcgaaagaaattaaaggacacataaataaattataggaccccatgttaatggattggaagaattaggatggcttaaatgttcatactgcccaaagtgattgatctatatattcagtgccatccctatcaaaatcccaatggtagcagggcatagtggctcacacctataacctcacagctttgggaggccaaagtgggaggattgcttgaggccaggagtttgagaccagcctggacaacatggggagaccccatctctctaaattttttttttaattagctaggtgtggtaatgcatgcctgtaaacccaactactcaggatggtgaggtgggaggattgctgaagcacaggagttcaaggctgcagtgagctatgatagcaccactgcactcccgtctaggaaacagagtgagaccccatccctaaaaaaaaaaaataataataataatcccaatggcattttttacagaaagagaaaaataatcctaaaattcatatggaaccacaaaagactctgaattgctaagagtacacaatggggaaaggatagtctttttaataattagtgttgggaaaactggatattcacatgcaaaacagtgaaattggactcttattttacaccatgcacaaaaatcaactcaatatgaattaaagatttaaacataaagcctgaaaccataaaacccctagaagaaaacataggaaaatagcttttcacactactcttctaacgatttcttggatatgacactaaaagcacaggcaacaaaatgaaaaaaaaaatagacaaataagactccatcaaactaaaaagcttctgcatagcaaagacatcaatcaacaaaatgaaaaggcaaccaagaaatgggaaaaaatacttgcagattttagatctgatgaggttaatatccaaaacatgtaagaaactcacataacttgatagcaaaaagcctttaaataatctgattttaaaaatgggtaaatgacatgcatgtacctttacccaaagacagaaatggtcaacaggtgtgtaaaaagatgcttgatataactcattgtaagggaaatgcaagtgaaaaccacagtgagatatctaccacctcacacctgttagaaaagctattatccaaactaaagataacaagtgctggtgagggggtgatgaaaaggaaacccttgtacactgttagtgggaatgtagattggtacaaccattatggaaaatagtaaggaggttcttcaaaaattaaaaatagtactaccgcatgacccaccaatccctcttgcggatatatacccaaaggaaataaaatcaccacctcatctaaatatctgcattcccatgtttattacagcattattcacaatagccaagatatggaagcaacctaattgccccaggatggatgaatagataaagaaaatatgttatatacacaaaatgggatattattcgaccttacagaagaatgtttttagtacaaccacaataccatcacgacccaagtaaaattaacaataatttctaaatatcttctaatacatgttccatattcaaattctcataattgtctccaaactgtctttttacagttgagttgtttaaatcaagatgtcagcatggttcacacattgcatttggtttttaagtctcataagtctcttttactttataacagttccgctattccttttttttttttcctcctatgaaatgaatttgctaaagaaagcagaccatgcttctctgtagatttaactaagttatggatttggccaattgtatcatcctggtataatttaataggttcccccattctttgtatttcctgaaattagatgttagctgtaaaggcatcattaaatttagctcccctctctttttgcaagtgtatttcaagagcagcatataactgcctattgcatcccatcgggaggtacatgaagactggctcctctacttgtagtaatgctaagattgatcagtgggttcaagtgttttaagcctgatccatctatcttaaatttgcccacctacttttcacttaaaaattgtagcacccttagataatttttgcctggacccaatctagcattttctgagagtttacacaattataattttctggtcctgagtttattagtttgagttctaaaaataatgttttcttagaagctgttcatttaccctgaaatacaattcaaacacaactggcaggttaaatgttgcattatcatactttatttaccaatttttagaataatgagttgattccttagtaaactccaaagtagactattttttagcattatgaattatcttctgtttatatatttcatgtgtccattgcgctcattagtcctataatgctcaaattgttctaactttgacagcaggatttccctaaggttggcttctgtgttgctttaacaggacccagtagatattgcttctggcactagataccccaagctcatcttgtacataccctgtctcagacctgaaatatcccatttctcctaggaattcaggttcatttaatagggattggtatttaagatgacaatttggtagctaggggtaagcgttacttcaatgcttttattcagaaagttgaggtgagaaaattgtaatttttagaaaaagaaaactaaatcctgagtacatagtgatatttcaatttcacatgcgagatcacatgttaaatacaaaattgtatcatacagtgtaatctcttttgtcttatcaaaatttaagttcctaatgatattgatatcattttttgctttccctctctcttctctctccatatagattcaaaataatactgtaatattctaacaatgagatttctgattgcagtttaagatttatttctgttttatttttgtcctctgaatatatgctactaagaaagtagtgcaaaaatactctgttttaaagtcacttaaaataattctttcttgtgtgtttatctaccaatttgatatgtaaaacatttttcagtatgttatacatttttaagaatttacctttaaaatcttttgtttcagaatcatttaaatcatttacacacttaccgagtcaaaactatagaaaaagttagtttcagagaaatatagattctattttcttccaagctgtacttcccttctttcctataagtaaccatttttattagtttatcttttgcttctttttaaagttaaaaatagcacacatgtacaaatgaaatatatcacatagattgttctgcatcctgcatttgacagtatgtcctggagctaccactccacaggatatagatcttcctgtttgctttttacagctgcataacactcctatgggtggatgtcctatagtttactcagccagttccctcttgataaacagttacattatttctagtgtctttttaattaagctattgtaattaatagctgtttacttggatcatttcttatttttgtgatgcctgccttgagactgatttctagaagtgaggttgctggtcaaagggtaagtgcatatttatttttgctagatattgtcaaattactattttcattctcagacaactcatatatacatacctgattcatttgcaaaactgcagtaataatatctcctcccagaaatagtgtgacactaaaatggctaatggaaatcaaaacactttgaaaaaaatgtaaagcaataaacagatatagtgatcagtattaataaataacaatccattgttagagatgattcatgtagccacacaaatgtctgcccatcatctcattgagtctaagactgaagtgaagaaccaacttcagacataggaagagagacagaaaagaaatagaagtatgtaagaagctattgggaccataatagaaaaaaaataacattggccttggtctggagagaatggggaagccaaaattggaactgagttttgaaggagacaggaatgtgccagatgggggtaatagggcaatatcaggtcagaagtggagaggctgccccagcaagaaaggagtgaaattttactgggagagtaaaaattcaggtatgggaaagcttagaaaacactcaagaggatggcatgagatgttagagaaatgggttgggactagggtgtaaagggttatggatactatgcaaggggattttcactttacacaatatatagttttgtgtgtccgtatgtttgtgtgtgtgaagcgggttggcctgtaatttttcccaaatctcatacttctatatttctcacaaaagtaaaggccagcactaaatagcaactgattagcattaaatacatgcacattatatattatatactatgaagtgatattcaaactatccataaagagttcctctagaaataattgtttcaacgaccaactgcatgaaaaagaattcttattataccaagtcacattttgcctttggtgacactttctgaaaacagacagataaaacaaaagcaatcaccaccctcacatctccatgtcttcttcctgctatctgggacagtcgacaaatccaggggagttgcataccaattctattaccatggacttggctaagccatttcacaggcgcacgagatttccggaatattaactgagaggagaggagggacttgagagtgcagccaggaaaggcaggatctgttttctccaaagccccaccacattcttccttctgaggctctgcagcctggagctgcctaaagactgactgcgtgactagtcagagaaattagagaaatatgtgctaggagttgggatcttagggatatgtttatttttatagctttatatagtttagtttttggattgaagtagctctttagttccaaagtcaacaatagatgtgctgtagcaggaatagttgtttctcttttaaaatttggttttatgaatctcatgacccatgtaatcaattattctcgtttcctcagttgctaagaagcttatgtccaaatttgtgttcttctcctagcaacttataggacttcctgtaatttgagattctaatctcatccctggctctatttgatattgcaactcttcggtttcctcttgctttgttttctgccactgtttcttggaattgtgctttttcattttctcttggtaatgttaatataaaatgatatatgaaatgcaacatatatgcaaatcataaagcataacaatatagttaacatccaaataataggtcgttgcccataccttgcttctacctatgtgtttttccacaaacccacctccctaaaactactatcctgaattttatcattcccttgtttttttgaaatagttttatcacacatttatataagtctaaacaacacatttctcagtttttcttttttaaaagttgttttctatcataccatatatgtctgtggagacttggtatttttgtttacccaacattatgtttctaagattaatccatgtttctgtgtgtagttatgctcacttctttttcactactagataatattccattatgtgaaaaatatatacatttgaagatagaggtatgttatgttttatatatatatataaacatatatataaacatatataaacatacatatataaacatatacacatatatatatatgttatatatatttctctgttctccaatagctaaacatttggattggattgttactagtttgagactgttacaaatagcctatgaaacatacaaatggcctatgaaaattactatttagatcttctgataaaaacatacaagaatttctctgacactgtttggtcatagagtatgtgaatgctctgctttgagagacaatgacaatttcttttccccggttctaatttacgctcccgttgatacacttcctctgtctaccttcttaatttgttgccattctggtgggtgcgtggtgctatattattttattcttattttgtatttgcattagtaaaagatttgtgaatcttttcattgtttatcgcctatagatatttcattgtctgtgaagtgcctgttttatgtatttaccccactttcctattgggttgttcatgtttatcttattcagttatatttctgacttgttctggtcactaatcctttgttatttgctttacaaatagcttctcccagttagtggcttcattttccctctttttctagtttgttttttgatgaatagcgatacttaactacagagcagtccaagatcttatactcagatcttttttctgtcttaaaaaactgtccctgcacgaaggtcataaaggttatcctatattttcgaaaatgtttaacgttttgcatttcacattagagtcttcaatgcttctgcaattagtttttatgaatgttgcaatttaagtaactatccaattgctttacattttccacatggacaaccattttctcccagtaccatttgctaaagagtccttctattgcctagttataagcaaggacacctctgtcatataacaaagttctatatatgcattcacatttcttgggtctttatcctaatttgttggccaatttggtttttaaaagttttatgtttaattgacaaatagtcattgtatatatttatggggtacaatgtaatgtttcaatacatgtatggtcaatttgttttaacacattttactaccacattgtcttagttgtaacagctttataataagtcttgatttttggaagggaaagctctcctgtccccattgcagactgacaaagatctgattgttaagtttaaaaactgacttcttatattatagtctttgcactttatataaagaaatcatacagtatagactctttcgtgcttgtttttctcatcgttatgtctgtgagatttacatatactgttgatatagcgatagctcatttattttcacagctgtcattgctgtatggtattctgttttataaagatatctttttttttctctactttactataaaatggatatttgggttgtttccagttttcttgtttttgtttctttatattgatttttctttactcttgacctattaagaaaggtgtgttaaaattttccactaagtatgcaacagtgaatgtatcaatttccccatataattgtgtcaaccttttgccttatcaattttgacatatttgttatgttcatgcaagtttagaattatgttatcttcctgatgagttgaactttttcaacttcatgtagtgaccctcttcattttaataggcttttttgttgtcttaaagtctgttgggtcagatatttatataacaatattcttttccttttagtcagtatttacccagcatatttttatctcatacttcagtttttttacttctgtgctcatgctttaggtgcatctttcaaaaagacctagtgatggttgtaatttttccatttttatccaatatagtaactactgtttttaattggtaagtttagtccatttataatcacttactatgtattaggatttgtttccattaccgtatcttacttttttatttctatttgttgtgcttaaaaacgttttccttctctttcaccatcctctagaggtttctttgagtgtaagtcactgggggttaaagtttcacagtttatgatgatattcaaatacctttattttgctttatagagaaatagttttctgagtataacattctaagttgttatattttctctaaacatttttctcattttgattttgctgtttagtagtctgctatctatctaattgtctttcctttgcaggcaatctttcctattttattacttttaatatatctttgtctttgatgttctgtaggttctctacaatgagcctttgcattagtattttttggtttatcatgcttggaattcattgtgttttctatatctgttcacattttccatcacttctgaaaatttcacatcctggtgagaatcccaaaaggaatgaatagaaagaatgcaagaaggcaacttggtgaactagctgtagttcattcattttcataactaaatagtaccctattttatgaaaatattatcacatttctattctactagttacattttaatttctacaacttctaaacttaccaaaatttctagtctattactaatggcctcttattgtttgcaattgctttcttttaaaaaatcatttcaaacacaacagttttatattacatgcgttacaatctctatatcaatagttatgggagtcataatgtgttctggttttttctgctgattttttctcattgctgttttttgtgtgtgtgtgctgtttgattgtgaagtcattgcttgatgcaaatgtatgagagtgctgtctaaatgaaggaagattacctcataaaggctttgcttctgcttctgctaatggccaatgcccacttcctaggatccatttttacttcccttaaagtcccggtttagttcagagtcccacattcagtttctccattctcggctctagatcaaagcttgttcataccaacacagacattgctactatagtcattcatactcaggaagtctccctttcccagctttcttccactccatattcctagcttatacccaaaacctgttttgggattatagggcttctggggatacttgcctaccccctttaaacccagtagtgtgtgttctatcccaattgtaactactctgcagtctcaacagcacttacttttccataatgccagaagcactcaatttattttttaaatcaaaatgatacacatagtaacaaacaatagaaaccgaaaaaccgtgatagcaatagatttcctctccttaaccctccatcaagtaccatttccctaaaacaacttattttgagtgtttctcctcacagaatttatgatggtaacctccacatttctaaataatatacatatacttctattttctcatctaggaaagatgtagatttaagtttactaattgtatcctttttcttttctcctctgaatctttgatatacatattagacttatttcttctattaattacatatgttaccttaaacaatacattaaattccttgttctgctaacttccatcagtgtctcttgactccctctgtactttgaggctattagcacacggaccatttcttccatgtttccaaccaccctccactcatgtcctagccttagctaatttgaattacatacatttattttatcaaatagtttacatttaaattctgttctcaatcaatatcaacatttcaagtatttttgataggatgattataaaacctcaaaatcaataaatagcaatttcattattaggacaatgtcaacactttccgtgcaggtcaagttctaccttgggactgtatttccttcaccttgagctcaaggctgtgatccttgagccacatgaaggggaatggttctattatagcatccagtgtaagtaggtactatcgtcttatactttttaactgctgaatattatattacaatttagttggtttcatagttagaccgtgactttctaaacagattttctgtttttttttgctggagttttaaataatgtttcttttttaaatggttttcttttatcagccctttccttttttccccaaagtactcaatcatacattctattctatcagtttctcctatccctcatcccactacccggaacatttccttctagagtctctgttagatccaaacattgctccagcactctcttgagttggatccacagtttcccagttcccatgtattcttcctccttggcttaccttttttctttttcttttttttcttttttggaaaagcacatcctgaaacaactttctaagaaaaggcgtgtgggtggaaacatttatgaactcttgcgtgtttttaattccgtcctcacatttgatttgtaatttttctcagtatggaaacatatgttatgattttaaaggcactgcttcatcacgttctagtatacatgcaatgttgccaacagatcttaaggatattctgattattcttatctccttttaggtgcccttttgtaagtgtcctctgaactctattcgattaggttattttcatggaaacttaaaaaaaatctcatttgttggtgatatcctctcccattttcttccccgttatagatttattcctttttgataaatttattctcttatttcataaagaaataaagaaggatgtgaggcaaatattcactttctagtctatcttctcaaatgtccatcacttattttcaatatattatgttttcatactgtattcattttttcagatgcttaaaattccttttggaacaaatcaggatatagtatgtatgcagtcattaaataagtttcaaaaagctgaaggttagatgagatgttcccctaattcaggctcatacatttttaattccgtgatcttgaaaaatattggagtattgatttcctaggttagctaagaatagatgcagacccatgggacccagagagtctaacaagtcaaaatctcaaaatacagaggtatggatagaatcaaacaactccaagcaatgaacaatcttaaaagcatcaaggcaagtatgattatgagaagtgaagaaatgcactggtgaaataatttttggtaaatatagctgtgaattattttgcccaaggctgctttcggagtgacagtcagaacctcttgcctgaggcaaacaggtaattaagaatgactagagagttttggacaacaacctgtgttggaaggaaggaggccacacacaagggaaataaaaaggcccattaaaagtttctggcttttgaaataaagttacatggtctggcatatctaattagttctcattgttatagaccttattacattccacatcctgtctggggttatcatatttgacattcaaagaattgttaaaatttcaaagatggcttgttttacttccttacctttggtaggtctccacagagaggggccgttgtggccaggcacggtggctcacacctgtaatcccagcactttgggaggccaaggcgggtggatcacttggggtcaggagttcgagaccagcctggacaacacggtgaaaccccgtctctactaaaaatacaaaagttagccgggtgtggtaatcccagctactcaggaggctgaggcaggagaatcacttgaactcaggaggtggagattgcagtgagctgagatcacaccactacactcagcctaggcaatagagggagactccgtctaaaaaaaaaaaaaaaaaagttggggggggggcattttacactgtcatagggagttagttgtactccttgactacttgctcaaagtaaatagcaaggatggaatttcaacatggctgccaaccactcccattctgtttgtttcaggtgaggaaggtactcttgcatagaagattgataggtctgtcagaataggaagactgaatgatcttagctttctttcatcaaatactttaaaaatacttggtaactttcaggctttgtgcaaagcatgggagatacaatgatgaataaatggacaggtcatgagaccctaccctttgtacacaagtagtggattgacctcatacacactccaaaaaaactgacaatgcctttacttaagaaaatccatagcatccgtccttctaaagccagacatctacaagaccagggtagggaattccctctggcttaatcaacacagttgtcatttcatttgggttatctctgagagtctgtgggaaactgataaccttgacaaaactcagagggacctgaggacctatttgttctacagccccacttggaaagaaagaaagagagaagggagggaagatggaaagagggaagaaagagttgtatatactaaaatgtgtacagacagagtaaattaaaattcattcgttcatttagcaaatatttattgagatcccactttgtatcaggcactgttatggagattatgtatttagaagtgaacaagatagacaaaagtctcttctctcatggagtttgtattctaattgaagagaggcggaaaatataaggatacattggtaaaatatatagcctgtaagacagtgatcaaagattagaagaaaaataaagcaagaaagagaggcaggaagtgtcaaggattggaagatgcaattttagatatgtgttcagagcaactgtcaatgagaagatgatgcttgagtaaaggatggaaggaagtgaggcagtgtgtgtaagtcgcgtgaatagctaggagtaaaacaattcagggaggtggacagggcaagcgcaaaggctcagagacagaaggatgcctggccattttcaaaggatattgagcccagtgtaactatattagtatgagggaagatgagagaaatagatgatggagtcagaatggaagtgagaggctaaatcatgtggggccttgtaggtcattttaagtatccttactgagacaagtggcaagtcattggatggatttgaggaatgccatgatctgacttaggtcttaaagaattattctgtgaaggtggaaaggttaatgcaaatgaatatactgtaaactgacaccacaagaacaataacaataaccaaggagagaaaaagaaatcttctatcattaaacagtggctttcatggtttctcaagagagctgtaaaatgctgacaccatttacaaagctttgatgttcagagagtgctattctgcattcctagaagatataaaaattaatgaccgatgagctcaaaatagctggaatctggacctatggatagcctttcccaagaagccacatcatcttgtacctcagacttaatttgcttaatcagcatgtgatggggcacgactttaatagggagtgacaactgacaagagaattaaattgatgcaaattaaaactttaacaataacattatatggagcttaaaaatcctttgcacttttgacactcaatttataccagatgctaaaatccactagaataaagggtcctcgcagaactatcagccaaggagaatccattgtatttataagaaaaacaatacagagattcttagtgtcagttacagacagtgttagtaagctgattatagaaacatatctctttaatcaaaccactggataaattttaaaattataatttattactggggacaacagtagttctgagtgaatcaggaatagagcacagggacagagagtgaggagagtaggatccaacaactactgtgactactccatcccaggcactttaaataatttagcaccaaaacattccatgataaatatgtacccatgtcaatccttagtacatgtgaataggatttgtgtgcgtgtgtgtgtcccattttctaagccattttccaagcctaatttattttaatttgactgtaacatatttgtaccattttcttctttataaaaaatacagtattggtcctatttgatgctttaatacactaaccagtctaaggtaccacaaagtcaggagtatttcttaaaccgctcctcaaattctgctctcatttcaatgctctatattaaaatttagaatgctcagatatatttccgaggactgcataaactacttccttattctgtctaaccataaccacctctactacatacgcatcctgctcctatatgtaacttctgagtcagtcaaggtagtatgacaaaaccacggatctatattgttcctcagtattcaagatgctaaataggctcattcctgtatctgttgtatctaagcctttactccatgacatagagtttacatattttttccttcccacatctttgtctccacatattttaacaactgaaatcccacctccgtaataaagcattcccaaaactttatagcccaacttcatctctctcttctctaagatcctatagtacttactgtatgcattatatattttaattttatattgcttgtatactattttccaaatagcatatgtgtgtatgacttgccttttcccagtatggttcttaagttgctggatcattctgcttgtgtatttttgaaaataactggtatgatattgactatacagcgcacttgttggctatggaacaactaaaatgtttcattaattcatttaacaagaattttttgaatacctactacttgaaaaaataagacaagacaaaaccagctctttctttgtgcataccctaataaaatataagaaagaaattatgacatctggcctcagaagaaaataggacacataatcataacttgaagtgcttttgaaatataaatactttcctatcctctgtataatcaagaatctccctttacattgttattcatgaaggatcgagagatcatctcctccaaaacagaacgacaaaattaacaataatcagtattaggaattgaaatgttacatataaggcaatgtttgcctttattttttgttttagtccagtggtaatatccctgcagatggtcaacctgttgccatttttgagtcagcactgcactttttactgtatttctcattttgtcattaccattaaatgcattgctgtgcccttcatcaatgtgtacagcaaaatgcaggcttaaaatgaagacatcagtggtactatagttagtaccattaataggagggctgatattttggctgtgctccacatccctagttccagctacctaatggacagtttcaggtagagctcttacaggtacctcaaacttaacaacatgtccaaaagtcccatagtctcaattaatgatatttctagtcgtaagcgtcaaaattagcatcgcctcctcctttcttaccctcacaacgaatcagccattaaattctgtcaattccatctagaaaacgtctttaaaattcttgctgtctctatcatgactcatcaaaactatgataatagcatacttttatttctctgttcatatttcagaaagctctttcttgtataatctcatgtttgattatgttaatttaccacttagaaaccttcagtgtgtgctcattgtctttataataaaattcaagtcccttaatcttaggttcaaagctctctagagcttggccccacagactttttcaacctttatgtctgttcttggtaaacaacacgcagacacacacatttcttcccagaataattcttcaatctccttgcccttatttaacctcgaatcttctccaaaaatccattttggaaaagggctagatagtaactactctaggctttgtgagccatgtggtcccgtcttaactactcacctctgccactgtggcatgagaattagccaaagactatatacaaacaaatcagtatgaacatgtcccagtaaaattttaattataaaaacaggtccagtgtggattgggcctgtgcttactggtttggtgaccagtgatctagatcatagtacaaagtgacaatgctttcatcaagcatgcatcaaaagagtattctattttttaaaacagctttattgcggtataattaaaattgtaaaactcttagaaaaaaacataggggcaaaaacttttgatactagtcttagcagtgatctcttggatataacaccaaaagcataagtaacaaaagcaaaaatagacaagtgagacaaaatcaaactaaaatgcttctgtatagaaaaaaaatcaacagagtgaagagataacctgaagaatgggagaaaatatttacaaattatttatctgacaaagggtgaatatccaaaatatataagaaactcccacaattaaacagcaaaaatccctcaaattacctggttaaaaaatgcaaaagcagcaaagaaaacaagcaatagagtaaagagataacctacagaacgggagaaagtatttgcaaactgtgcatctgacaaagggtcaatacccacgataactcaaataacagcaaaataataataataataataataatgcaattaaaaatggacaaaagacctgaatagacatttatctaaagaagatatatacaaatggtaaacagatatattaaaagatgctcaacatcactattcattggggaaatgtgaatgaaaccacaatgagatatcactcaaccccagtttcagtggttattatgaaaaagacagaaataacaaatgctggtgaggatgtggagaaaggtaaactcttatgcaccattggtgggaatgtaaattaatacagcctccgcagtgtggaggttccttaaaaatttaaaattgcactaccctgtgacccagcaatcccattactgggtaaatattcaaaggacattaaatcagtatgtcaaagagatatctgcactcccgtatttatttcagtagtattcacaatagctaagatatggaaacaacctacatgggtatccatgcacagataagcagataaagaaaatgttgtgtgccacatggacataaacatgggaacaacagacgctgtggagtactagaaggggaagagagggatgagggcatgggttgaaaaactacctattgggtacaatgctcactacctgggtacagtatacccgtgtaacaaacctgcacatgtaccctctgtgtctaacataaaaattgaaattttaataaatgaaaatttttatatatatatataatatataaacacactatatatatacttatatatctatatatacatattctaccatagatatatcccactatatacttacatatctatatatacatattctaccatagatatatcccactatatacttatatatctatatatacatattccaccatagatatatcccactatatatatggtggaatatatgtatatatagtatgtatgtgtgtatatatatgtatataaaacattttcttttattaaaatttcaacttttatgttatatatagttcaatatactttttggtggaatatatagtatatatatggtggaatatatatagtggaatatatatattatatatatagtatatatagtagaatttatatatattatttatatatggtggaatactattcagccataaaataggatgaaatactgtcattcgtagcagcacggatgaatatggagggcattatgttaagtgaaataagtcaagccacagaaagacaaatactacgtgatctcactcatgtggaatctaaataagttaatttcataaaaagagagagtaaaatagtggttattaaaggctgaggagggtagcagggagtggggaaccgggaaaggttggtaaatcggtacaaagttagtaagatgagaggaacagggtctgatgttctattacacagtagagtgactataccaaataacaatgtaatgtatatttcaagttagctagaagagaagattttgaatgttatcagtacaatgatagatatttaaggtgatgcatattataattaccctgatttcatcattatacaatgtatacatgctttcaaacatcacactttatctcataaatatgtacaattattatgtgtcaattataaattgaaaaatactaaaggaaggcaaaggactggaatagacatttcttcaaagaagataaacatgagcaccaagtacatgaaaaagtgcttagcatcactaatcatcagggaaatgcaaatcaaaactacaataagatctcacctcacacctgttgggatggctattagaaaaacaaataaagaaaaaaacaaaatataaatgttggtcagaatgtggagaaattggaatacttgtatattgttggtgagaatgcaaaatggtgcatgaaaaacactatggaggtttctcacaaatagaactactgacgatgatccatcaatcacacctctttgtatatacccaaaagaactgaaatcaggatctccaagagataacctgcactcccatgttcattgcagcattagtcacaatagccaagatatggaaacaacccatatttctatcaacagattaatgaataagcaaatgagtattctgttgcttgtatatcacaaatgattttaaaagggtgatggttccagtggggagagaaggaggaagcagggcgcagggaagctggtagggtgcggggaccagccactgtcaccgccaccacctctggtcctggtgtgggaaaggaagtgtgagtcttaggtgcaagtctgagatggtgccactgctggagggctggcagtgggaaggcaggagaaaaataggtaaaaaatgcgaataatttgaatatttcaaatgtattttcaaatgtatatggtactcccctgctatctgtggtttcacttcccacggtttcagttatccacggtcaactgaggtccgaaaatattaaatgtaaaattccagaaataaacaatgcataaggtttaaatgatgtgccattctgagtggcatcctgagtcatgtgtcaaatctctacacacaccactctgtcctaccagggatgtaaaacatccttttgtccagaatattcacactgtatacactcttcacctgttggtcacttagtagctatcttggttatcagactgactgctgcagtattatcacagtgcttgtgttccagtaattcttaatttacttaataactgcctccaagtgcaagagtagtgatgctggcatattgttataattgttctattttattattagtgttaacatcttactgtacctaatttataaattaaactttatcataggtatgtatgtgtagacaaaattatagtatatatagggtttggtactatccatggtttcagacatccactgggggtcttggaacttatcctctgtgcagaacgggagactactatacatttgctttcattaacagaaacaagaagacaagataggaaggaaagtacatctcatattgtcagtaactatggatctaaaaattccaactcctcaaactgcataggaacttatttctaagaaatatttaacaaaatagaatgcaggttatcagattaacttactagtaaacctatttcaattatatttgggatctaatgacagtaattgtggtccccgagattctgttacctttacttttttatatgtattctttcttttacagttttctctcttcccaataacccctcaataagtttaataggattaaatgtattttactttatacatacagatatatttgccagtttgctttgctccttaaaacccatgggtctctatagcctatacattatttaattatttgaattttacaatataaaaatgatgtatggaaaaaacaaagaatcagaaaagtacaaacaactttgtagaagaggaacaaagttgaaggatttatactacctaatttcacagtttacaataaagtgacagcaaggcctgtggcactggtgcaagcctagacatatagatcaatagagagttcagaaatacatctgtatatatatgtgtggatattggcaaattgattttgaacaaaggcgcaaaggtaattcaatggaaagagagtactctcaacaagtggacaaatggtattgggacaataggaaggaaggaaggaaggaaagaaggaaagaagggagggagggacagaataaagagaaagagaaaaaagagaaaagagagaagaaagaaagaaagagagagagaggaaggaaggaaggaaggaaggacggggaacatcgattctttctttacacaatatgcaaaaattaactctaaatgaatcatagacctaaatgtgacactttatgaaacttctagatgaaaatatagaagacatttttgtgttcttgggttaagcaaagatttgctatataggatataaaaattgcaaatcataaaataaaaattggacttcataaaaatttaaaatgtctgctctttgaaagacacaagagaatgaacagagaaggcacagactgagagagaatattttcaaacacttgtctgataaaggacttcaaataacttgattttttaaaaatggccaaaaatttgaataaacattttatcaaagaagatatgtaaataacaaataagcatatgcatgctgctcaacatcataagtcatcggggaaatgcaatatacaaccacagtaaaataccatatggccatattagaatggctaaaattaaaacaaaagacaataaaaactgataatgccaagtgctggtaaggatgtggaccaactagacttgcctagatgtagagcaactagaactcccacagtttattggtaggaatgcaaaacagtacaaatacttttattggaaaacagtctggtagtttctcataaagttaaacatacaaccaccatacaatccagtgatcctgggaattcctgggtatttacccagagaaatgaaaacatctatctacttgtatgggaaagtttatagtagctttattcttaattgccagatattggaaatgactcagatgtccatcaattggtgaatggatacatgcatacagtagaataatgctcagcaactgctgaatggaaatatccacacaattgaaaaatacccagcaataaaaaggaatgaacagctgatacacgcaataacatgggtggatctcaacatcattgtactaagtgaaaacacaaaatgatatatgattccttttctataaaattttggtggaggtaaagttatacagacagaaatcggatcagtagctgcctggaactgcagatgggaggaaggaactgagtacaaaagaacatgagggaacttcttggagtggtagaaatactcagttatcttgaatgttgtgttggttacataaatgaatatgtttgtcaaaactcattgagccgtatgcctcacaaggatgaattttactctatgcaaatgataccttaataattctaagcttaaaggatggtactgctctgaggaaaacactatccctaaacctacatgaatttcctctggattttatacatttatgagtctcttttttgggtacctaatctatgcatggttttattctttatccatgcttcagtgatcagacataactttcctccattaatttttctttcatggcagtatcttgaatcattttttgaaattttttctcatgagcgaactcaggaatttacatatttacttccctgggaagttctaaattcaaaatgtgctgagagtttgcttcctcagtctgtatctgagcattaaattaaatggctcataccctgaaactcctttactctcatacatcctgaggccttactgcagagttgcatgccctcagatattagagagcttttggctcttcagttatcaaaatacatgggtttgggaaggattttagacagaccttgctaatatttaaaattccactttatatttagtaatccaagctcagtaatattgttgggtattggaaattacaagcaaatttgaggccctcaaatctggcatccctcccttcactgaagaagtctaaaagacatttataagcaaaagggtttacactatgtcacagctgtttcagaacagaacactgtgacaaggacattacttcaggaaaaaagagacaaactttgtgttattgtgcattgaaaatatttacattccacccatgttaaatatcaggattaaagaactttggcaatgatattaccctgttgcaaacctgaacctaatttaccaagcagctagggtgacgaagtaaaaaggacaggatttgtagtttctttgctctgtcaacagatctgggtctctatgtaaaggctacaaaattaaaagcacaattacagtagatgtttaaagagtaatgatgcatgctctatgtctgagatgccacataaaattaaggcctatgggaaagttgagttgttaagaagtattgatttgaattacttaacaatatcaagagcatgcatacttttacctcaaatattttttacataaaaagccagtgaattgccaacagacatattcattgcaaaaattaaaatatcaacaatatcaggagtgtaaaatgagtgtaatatatccttcagaaggtaaacatttctaaaaattctgtgacatatcctttatggaatagtttttactttgcttgtaatttgtttctatgaaaacatttttgaccacttttgagacatctgaaaaagattaatagcaatctttttttttttttttttttttttttttgagacaaggtatcactctgtcacacaggctggagtgcagtagcaagatcatggctcacggcagcctcaacctccttggctcgagtgaacctcctgtttcagcctccccagtgtctgggaccacaggtacatgccaccacacctgactaatttgtgtagtttttgtagagatggggttttgcgacgttgcccaggctggtcttgaattcctgggctcaagcaattctcccgcctctgcctcccaaagtgctgggattacaggcgtgagccactgtgcctggctaacagcaaccctattttttctcaaaatgaaacaacataaaaaatagtggacttttactgaggaagtaattaatgaacattatgccacactttaaaaataagaagcaaaaaaaataatttgcaattccacattcagatatagccatttactcgttaatgctacaaatatctattgaatgtgttttatgtgccaggcagtgttgtaggcactggagattcagcagtaaacaaaacatacaaaatgttctgtccctggctgggggcggtggctcacgcctgtaatcccagtactttgggaggcagaggcgggtggatcacttgaggtcaggagttcaaggccagcctggccaatgtggtgaaaccacaccctctaaaaataaataaatacataaataatttttaaaaagaaaagaatgttctatccccatagagtttacagaaacccttaacattttgcttcaataatttatatgtatatatatatatatatatatatatatatatatatatatatatatatggtacacacacaaacacacaaatacatacacacagatgaaagcatggtattattctatagatatcatttgtaatctgcttttgtacattatattctactgtgaacttctttccttaccactaaatatgcatttatatcattacttacaattagtgcattatatatcattgtatgggttaccctaattaatttaacaatcctcttttgatgggcaattgtttccatttttgcattataaaggatgctatgataatatataagcatgtttctaataatatacattgcaatcatgcacatatattcacacacttgtccaattattttacaacaatacattcctagaagcagaatttttgattcatagaatattaacaattttaaggcttgcatgacttttccctaggattgattcttttctaaaacaggaaaaaaagaaagcaaagtatagcatatgtgcttcattcaaggtgtgaaacaaggatacagatttatagagtagcatttatcttccaaggttaccatgtgatgccaatgtctttgagtattaacaagatgatcaaaagggcaggccacaataaaaaccagtagtgttgaaatctttttctattagaatttatcaggctttaaaacaaaagaccaaattaattgagatgttttgtacatttcatgtatattttagttaaaaattcattagatttccattccaaaaaatatccttgaattcttctttggtgtaatatcagggaagcactctaagctctaaagtttgtctgttttcctatagtcatttttgaaatgccctataaaccattttattaacaaaaggtacttataaaacataattaagctataatcacaagaaataccatagcataagctttttcttcagagcatctgattttctgaaaacctgtagaaagttcagaatgaaatgtggttgctctaacataatgttttattctgcctacgatgtgtactcttattacgtatgattttaagaacaaaattgatcaagcatattttgttatatgtcttgttcctcctatgtaaattctatatgtcatttatagcaaaataagtcactaataatataaaattaacaaaaagaaggtttatgttaaggaaccacgatacagcaaagcagaatggcaaatttgagaaaagtgacttcataagatggttacgaacatctataattgaattggtttctttctaattacagatttataatgagacatcagatacaatcaatgacaacatgaataataaattattctgcctattttaattcaacataatacaatggaaacagaaaaattgtaatgatccttgaattcagcttgaagatctttcaggttattcaacatttccttgatacctccccagggtcatactaggggggacatacgatgaatgtttgcacaggtataactgcttgtctatttctatggtttatagcataattttttccatatcctacagatttacattggaaactgtagattttgaaacatgtagttccttatgtaagaactggttgccaagtaacatcagaaggatttcaggaccaaaagcattccatcctcacagagaattaacttttgccttgaaagacttaacagcttctctgctgagttgcacagaaaaagtgttttggggagatatccttgaacttaatgggggatctgtcattattattatttctgagtgccaaggagctactctaaggatacctgtgaagaaaaaccctttagaattcctttttgtagcatgggctctttccagtgtcacttgcctcgtggctccacttctgctgggcattccagaaagaaaattcttaaagtacagtgaaaactatagtagttaaaaaggcgaacatataagataataaccgggaaacgtaagattaatatattaaaatgaaattaagaacaatataagataaaattaaaacaaaaagggaaataaaaggtcaaaataagcgctacacaacttcaaatataaaatagtgactttgaaatgtattttaaaatctgaaatataagatgcaaggctagaaaaaagatatagtcataaacacatctgtagaaaataaatatttttaaaggtatagaaaacaataaattgaggtttttatttcaaggtaattatgttttaagacaagggatattactagaaaagatagagctacacaatttaatacagatgctccttgacttatgaaggggctacattctgatagactcattgtaagttgaaaatatcctaagtcaaaaatgcatttaatgctagtaacacagctgtatattaaaatagcaaagtacaactgaggataattataaataaatgcacataaataaggataattttaaataaatattagagctaggggtatgagtcctcagcatggctcccctggcagcgggggaccttccagaagagagccccatgggaagtagcactctagaaggagaagtcgtctgagaaaacatcaagggtattagagacccctcccctgctcttcgttaagttctggatccttcaacaacgtcaaacatccactcagctcatatactttaaaaacttttttatgatagaaatttctaaaattgcgtgacaatagaagcagggcggaactaacctccatgcactcttcccacagcttcatagaaatcaacatattaacatgtagtcatttttgtttaatcacttctaaccctatgttgctgttgctgctcttttttcttcactttttttctcctccttctcctgttcttcctgtacatattgaagcaaattcttgatatttttctatgatattttgctatgaatctttaatacataccttttaaaatataatcacaatattatcgtcacacctgctaaaactaacaatagccttatgatatcatctaaaacctagtttatgttcaaatttccacaactgtcccaaaaacattttccaggggatttgtttaaatcgggattcaaatgaggtccacacatcacatggttgatatttctttcagttttttttccatctatgaaaattcccctcacccccttttttcttggcacatatcatttaattgtttaagaaatggcaccatttatcctgtagaatgtcttacattctatattttactgatagtatcattttagtttcatttaacatatttttctatactcatattttctgccagttgatagttggttctagaggctgattagatttaaggcttttcttctctttggtgagaatattaataggtgatgctgtgtctctttttgcatcatatggaaggcaattttactgatgttaataatgggaagtgggttgaggttttgcaaacctgattcatccattataaaatttctcatcatttacctaatagttttagcatctatcagtaattttgacctatatccattattccaaaaggtgttgtaaaatggtaactttttaatttgatcatttttaattttttggcatttaccaactttcatgttatctttttttcacagaagaaattcttttttaaaaaaagaaacttctatttcagattcagagggtacatgtgtaggtttgttacattgggtgtattgcatgatgctgaggtttggggtacagatgatcccgtcacccaggtagtgagcatagtacccaataggtagtttttcagcccttactcccctccctctctctcaccccagtgtgtattgttcccatctttacatccatgtgtactaagtttttagctcccacctgtaagcgagaacatgaggtatttagttttcagttcctgaattaattagcttagggcaatggcctccagctgcatccatgttgctgcaaaggatgtgatttcattcttctttatggctgcgtagtatttcatggtttatatgtaccacattttctttgtccaatccaccattgatgggcacctaggttgattctatgtctttgctattgtgaatagtgctgagatgaacacatgagtacatgtgtctttttggtagaatgatttattttcctttgagtatatactcagtaatgagattgctgggttgaatggtagttctgtttttagttctttgagaaatatccaaactgctttccacagtatctgaactaatttgcattcccaccagcagtgtataagtatccccttttctctacagcctcaccagcatctgctatttttatttttttactttttaataatcaccattctgactggtgtgagatggtaactcattgcgattttgatttgcatttctttgatgattagtgatgatattttttcatgtttgttggccactagtatgtcttcttttgagaaatgtctgctcatcttgtttcctcatttttaaattcaattatttgttttttgcttgttgatttatttgagttccttatagaatctggatatcacatctttgttggatgcatagtttgcaaatattttctcctattctataggttgtctgtttgccctgttgatagtttcttttgctgtgcagaagctctttaattaggtttcacttgtcaatttttgtttttgttgcaattgtttttggagactttgccataaattcttttgccaaagctgatgttgaacggggcattttcttgattttcttctatgatttttatagtttgaggtctcacatttaaatttttagtccatctttagttaatttttgaacatggtgaagggtagaggtccagcttcattcttttgcatacggccagcttattatcccagcacatttattgaatagggagtcctgtccccattacttatttttgtcaactttgttgaagattagatggctgtaggtgtgtgactttatttacggcctctctattctgttccactgatctatgtgtctgtcttttgtactagtaccatgctgttttggttactttagccgtgtagtatagtttgaaatggggtaatgtgatacctacagctttgttctttttgcttaggcttgctttggctattcagtctcttttttagttccatatgaattttagaatagttttttctatttttgtgaaaaaaatgatgttggtattttaataggaatggctttgagcagtatggccattttaacaatattgattcttccaatccatgagcatggaatgtttttccatttgtttgaaatcatctctgatttctttcaggagtgctttgtagttccccttgtagcgacctttcacccccttggttacctgtattcctaggtacttcatttttttgtggctgttgtaaatgggattgtgttcttcatttgattttaagctagaatattatttgtgtaaaggcatgctgctgatttttgtacattgattttgtgtcttgaaactttgctgaagtaattcattaagtctaggagccgtttggcaaagtctttagggttttctaggtacagaatcatatcatcagcaaagagagatagtttgacttactcttttcctatttggatgcctttttttctttttttttcttttctttttctttttttgagatagagtctcgctctgttgcccaggctggagtgcagtggcgtgatttgggctcactgcaagctccgcctcctgggttcatgcccttctcctgcctcagcctcccaagtagctgggactacaggcgccggccacaacgcccggctaattttttttttgtatttttagtagagacggggcttcaccgtgttagccaggatggtctcaatctcctgaccttgtgattcacccgcctcggcctcccaaactgctgggattacaggcataagccaccacgctcggcctggatgccttttatttctttctcttgcctgactgctctggccaggaattccagtactatgttgaataggagtggtaagagtgggcattcttgccttgtaatgtgaagcataaaaataaatcagattcatacaggcattttctatttaaatttaaaattgtcaggcttattacttatcacttatttgattgttctgaatcttttttcttatacattatgtgctacataatgacatttaggtcaatgatgaaccttatatatgacagtggtcccataaaattataatggagctgaaaatttcttatcacatagtgatgtcaggtgccttaatgccatggacaatgcattacccacctgtttgtggtgatgttggtgtaagcaaacttactgtgctgccagtcatataaaagtctagcaatacaattatgtacagtacataatacttgacaatgttaataaacaactatattactagtttatgtatttactatcctatacatttttaatcattattttagagtgccttctacttataaaaaaaaaagttaactgtaaaacagcctcaggcaggtccttcaggagttgttccagaaggaagcattgtcattataggagatgacaactcaacatatgttattgcccctggagagcttcaagtgggacaagatgtggaagtgaaggacagtgatattgataatcctgaccctgtgtaggtctaggctaatttgcgtgtttacatcttagtttttaagatggctagccacatgtaggagaatgaagctggatcctcatctttcaccttatacaaaaatcaactcaagatggatcaaagacttaaatctaagacctgaaaccataaagactctagcagataacatcagaaaaccccttctaggcattggctaatgtctagaagcttaaaaagtaaaaaaaaaaaaaaaaaaattaaattgatgaaagattatagactaaggatataaagaaaacaaatatttttgtacagctgtataatgtgcttgcattttaaactaagtgttattaaaaaggagtcaagttaaaaaacttgaagattataaaattaaaaaggtacagtaagcttagtttattattgcagaaaaatattttaaaataaatttagtgtagcctaagactacagtctttataacatctacagtagtatacagtaatgtcctaggtcttcacatttactcaccattcactcatccagaacaacctgcagtcctgcaagctccattcatagtaagttctctatatatgtgtgccatttttatactgtatcctttctatattttgatatgtttagatacatacatacttaccattgtgttacaattgcctacgatattcaatacagtaacatgctgtacagatcggtagccaaagagcaataagctataccataaagccaaggtgtgtagtaagctatatcatggaagtttgtgtaagtacaccatgatgtttgtactgtggctaaattgcctaagaaagcatttctcagaatgtatccccacggttaagcaatgcatgaccctatttaatatcttctttcctaaattatattagcaataattatttagtttctttattctactatttggtatctatacaccatagtcttgaaataacaattcaaaaattagtatttaaaataatgcacctgaatgcagtttaagatttatttgggacacaaggaaacatttggaggtgatggatgtatgcatatatccaaactcatcaaattatatacatcaaatatatgtagttatttgtatatcaagtacgtttcaataaagctgtaaaagaatatttctttgtgattattttttcctttgggcatatctacctggtaatgtagggtcaaagtacttaaaatcacttgaagtaattctcagcatgattatgccatcagctagatagacatttgggctcatttgtttggttgttatttttagagattgattttttctttccaatttaactgagttttataattatgaaaaccatttgtgtatatggttccaaggtttaacattatagagcaaggtacatgcatagagatctaacttctagtcttgtcttctctgctagcttccctccatgccccactcagagtcattttttaaagtttttgcttattttcatattgtttcttttaaataatatggccgaactcaaacttttgctatttcaattagtgctgcaatcaactctgggcatatagtagtccatatttttgccggtatatctttgggatagattcgtatcttggcagaaatgctgggtcaaaagctaaaagaataaacagtgttgtctgatactgtcgacttctcttcaacagccgttgtatcattatcaacagcaatgtatgagagccgtgtttccacacagactggaaagcagactatgctggattttgtcaagcagagaggtgagaaacattatttcagtgtagctttaattatatctccattattatgattgaaattggtaacttttcacaagaaaagggtcatttatacttcttttctgtaaaatattgttcatatcttgctttttaaaagtcagatttttgatgtttttccactcaattgttagcacctctttaaatgttagagataaaatttgcaatgctatttgaaagtaattatcctggcttgtactctgcttgtggtattttggttttgctatgcaaaactttatatatttgatcacatgcattagtattttccttacttgcttttgtttttgttttcagagagcccaggagcagccttgaactcttgggctctagcaatcctcctgcctcagcctcatgagtagctgggacaacagacactacactgcacctgactaattattttattttcgaagagactgagtcttgctatgtcgcccaggctggtcttgacctcatggtctcaagtgatcttccaacctcagtccctgaaagcatgggaattacacgtgtggaccaccatgcctggtcttgcttctgtatttttaatcactggaaatgcaacaggttagattccccaggaagcaatctgtgagatggaaacaagggtgctggacttttttttaggaatccttgtaactactacgtgtgggtcagaggacttctaatagctggaggaataagctcttcctttgcaaggggttctgagggactcatcacagcatttaccatgggaaattctccttactccaagaagtaaacaaagataaaaccacaaagcaaataaggaattcatctatgccttcttacactacttgaacagttttttatttttttatttttttgcactttagatctcagatccatttggaactctgtgagaaattcagccaatgatatattcgttgtagtttttctgtggtgccaataacatattagaagacaattttcccactgacttgaaatgtcatcattatttaaaaaaatctaaatttccatatgcatttaggcctgtttctggatttctcttttctgttttattagtctacctctccatgtgctaataccaaaccattttaattattgaggcattatagtatgtcttaatatccagtgtggtctacccgccactattcattgcactttttttaggattttcttaggtattttttctaaataaactttataactaacttagctaacttcagaacaaaatggtgcttttatgtggatttcattaaattcatagatcaacttagagaaaacccccacatacccatttcccagatgcaacaatcatcacttcattaataatattatttcatctaaaacagaatctacctccttcttcctagattatactgatacaaatctgaaaatcatattatttaatccatatgtattttagtatatactttagataagtactgtttttaaaacatagcttttaaaacttagttgacacctaaaaacctacaataattacttattagtataaaatatctagtcagtgattaaatttctccaattgcctcaatttttaaaaaagttttatattctaatcagtatacaaacaatgttcacacattgcaattgatcgatatgtctcttttagattatagattgcatggttctgaaggttccttttggagttgatttccagttttattccactgtggtctgagagagctcttgatataatttcaatttttcttaaatttattgaggctcattttatggcctattatatggtatatcttgtagagcattccatgcgctgttgaatagaatacgtattctgcggttgttggatgaaatgttctgtatatgtctgttaagtccatttgttccaaagtatagtttaaagtcattgtttctttgttgactttctgtcttgatgacctgtctaatgctgtcaatggagtattaaagtcccccactggtattataaaactcttttctgttttattagtctacctctccatgtgctaataccaaaccattttagttattgaggcattatagtatgtcttaatatccagtgtggtctacccgccactattctttgcacttttttttaggattttcttaggtattttttctaaataaactttataactaacttagccagacagcatatggtattgctgtctatctcatttcttaggtctattactaattgttttataaatttgggagctacagtgttaggtgtgtatatgtttaggattgtgatattttcctgttggacaaggccttttaccattatataatgtccctctttgtctcttttaactgctgttgctttaaaatttgttttgtctgatatgagaatagctgcccctgcccctgctcacttttggtgtccatttacatgaaatgcccttttccacccctttactttacgtgagtttttaggtgttaggtgagtctcctgaagtcagcagatggttggtgagttcttatctattctgcggttctgtatctttcaaatggagcatttaggccatttacattcaatgtagtattggaatgtgaggtaccattgcattcatcattctctttgttgcctgtgtactttgtttctgtttttgtttttgctttttaacatgtatttttgttttataggtcctgtgtgatttctgctttagagaggttctattttgatgtgtttccaggatttgtttcaagatttaaagctgtttttagcccttcttgtagtggtggcttggtcatggggaattctctcagcatttgtttgtctgaaaacgactgtatctttccttcttatataatgcttagtttcactggatacaagttcttggctgataattgctttgtttgaggaagctgaagataggaccccaatcccttctagcttgcagggtttctgctgagaaatctgctgttaatttgataggttttcctttataggttacctggtatttctgtctcaccacagctcttaaggttctgtccttcattttaactttggataacctgatgaaaatatgcctaggtgaagaagttttgtgatgaattttccaggtgttctttgtgtttcttgtatttggatgtctaggtctctagcaaagctggagaagttttcctcgattgttcccctgaatatgttttccaagcttttagaattctcttcttccataggaacactgattattcttaagtttggtcctttaacataatctcagacttcttggaggctttattcatattttcatattcttttttctttgtctttgtcagactgggttacttcaaagaccttttcttcaagctctgaatttctttcttctacttgctcaattctattgctgagactttccagagcattttgcatttctaaaagtgtatccaaactttcctgaatttttgattgttttttctttaagctatctatttccttgaatatttctcccttcacttcttgtatcattttttggatttccttgcattgggctttgcctttctcgtccctccctgattagcttaataactaacctcctgaattctttttcaggtaaatcgaggatttcttcttggtttggatccattgctggtgaactagtgtgatttttggggggtgttgcagagccttgttttgtcatattaccaggattggttttctggttccttttcatttgagtaggctctgtcagagggaaggtctaggtctgaagactgttgttcagattcttttgtcccacggggtaatcccttgatatagtactctcccccttttcctatgaatgtggcttcctgtgagctgaactgcagtgattgttgtctctctttgggtctagccactcagcaagtctacccgggtccaggctggtactggggattgtctgcacagagtcttatgatgtgaacaatctataggtctctttgccatggataccagcacctgttctggtggaggtggcagggggtggggtgcaatggactctgtgagggttcttagctttggtggtttaatgctctatttttgtgctggtttgcctcctaccaggacgtggtgctttctggaaagcatcagctgtagagagggactggcagtgggcgggcccctagaactcccaagattatatgccctttgtcttctgctaccagggtggatagggaaggaccatcatgtgggggcaaggctaggcgtgtccgagctctccttgggtgggtcttgctgccactgcttggatggggatgaaattcccaggtcactggagttgtgtacctaggaggattactgctgcctctgctgagtcatgcagattgtaagggaagtgggggaaagccggcagtcacaggcttcacccagctcccacataaaccgaagggcaatttgcattcccaccatgcacctgccccaacagccctgagtctgtttctaggggcagggtgtaatgcgcttgaaaacctgccctgggctacccgcctcccagctgcagtagggggtgcgggggaagggcttggttcttcccctgcctgtggagcctgtagaccagatttgtgccctcccccaagttctggccaggaggcttcttggcccattcaaattgttacaaagttcagctagagatttcttccttatggagttgtacccgctgctcctctggtcaccctcctgatggatccctgtggttccaggcaggaatggcctgctaggggacacggcaagctcccaggtcctttctgctgcttcttcttcccctgtatttcacttggctgtaaattgactcagccccagttaaagtcagaaacttctcccacaaacagacctttggcttctccagtgggggtgtgtgtttgggagaggagggtctccctgtcccatttccgcagttggggcactcacagtatttgcggtgtctcccaggtccttgaaggagcagtcggcttccttcacagggtctgtgggtcctctcgggattgctgatttgttcttgcagttgatctggagctaaaattcccaatgtgagcttctgcaaggtgctctgtctggagctgcaatctagtcctgcctcccgtctgccatgattatttttcttaccaaggactgaagagcttttatttaacctcatcaaacgtacacatgtttctcctctctctcatgagagatgtctgggttctcagtgacatcagtataatgattaactttatctcacaacatatgcatgaccatttctgagtaatattaaaaaatgattatcaatggtgttacattcattcctttcattttcttttgagatttgtggattacctttcaaaattattaatatttctttacaattaggcaaaatatttacacggttccaaagcaaatctacgaaagtagaagtctagccacatctagcatatctgtttcctctattctcctcctataagtatttagctatgtaatttaagagagaagatagaattgggaattaaggagaaaacacttgaactcagaggttaaagtttaatcattgtaggaaggttgttgatcaagaattggaaatattcagataagtaaagtagaggataaagtggagtgattttaaatattcattgaatttgccaaaagagaataatgatagaagacttttttatgaacatgagcaaagagtatagaagagggagtgggcattaatgccaaagtcagcagaaaatcttggtaaaaatttacagagttaaaggtatttgatttctcaataatgaggtgcttttttaaatttcagagaaataagcttccttgaagaagcaaagcagagtttcaaagaataataaggaattgactggaaaggaaatggaaaaagatagcgtaaaaaccttcttgtgatcctgggtgttaaaaaagtaggaacaggaaacacacagggctgttgctagcttgcaaaatacaatcaaatgaagacactttatttccctaataagggaaatcttaaagtcaaagagaaaattatcagacgaggagtctacaaagagaagagatgaaggtggagcaaaactctcaagagtcagcaagagctgaattcaaggacaaagaacagtcaacaattcagtgtccatgcacagagactgggcctctaagtaaaaattatgggacatacagcttacaccaacgaagcatataataaatctgtatatatttctacaccaaatttaaattctcccatggaggctgaccctgtttcctagtagtgatatgcctgaaaaccaaaaaaatgccatgtcaggcttattctcctgatttactactccctcggaaacaaaatcaatccagttcattgctgatttcttctgagtatactggtgcatagttcatattctcaaatctactcctaattaaacacagaatggctgtatttgattcttttggatgccttaaggtgagttcaacatgccatgcttacatatatgttatccttggtcattgcccaggttgtaaatccctgggtcatttaaactcttccaaactcttattcccacattgctccatataggcctaccttgacctttactcccgtatttctccttcctctcaaatcatctcactgtgttctctgggaactcttatttcatggtaaactcttctgtattctcaaactctttgtcaaatattattccttccatcgcctagccctagtctgtattcaacactgctatttctaaaccatcattctttttctgacaaatgtccttttgaggatatgctgtcccactgaatctgtcattcattaacatctcatcttgtgtcagtttccaagcttggtttgtcagttacttgacatggtcaggaaggaaaaaaatggacatatggcaggtaagttgctgaggaagaacatggtgtactacctggaagacagaattagagcagacatagggaaggtgaattgagggactaggcagtatgtgtgagccacattaaatcctcaagtagtgaataaggtttgtggtatgttgaagctggctgataccaattcacaagagccagctgttaaattttcagaaattttgcaagccagtagacatcaccctggaagctctacaaatattataaatcaggacccttttctcccatgaaatctagttgtttaaatatttaccagcacaccactgggtggtaagaaggaagaggaaatgaaatactaaaaggatataaggtcaggaaagttgaaaacaaatttcacctaattcacaattatgtctaggagcaatatcactctaaggctaagaaataaaaacaaagtagacttaaacagtatatccaagaggggcaagattaaagatagattctaaagaaaaatgatggaaaatgtcattttagcttgacaaatatgattcatttgtattgaggctgaatcacaattgtaaagaaataaatggagatgatattgacatgttctcctatatccctagataccattaggttgaactcattaaacaatatttgtttattctgtgcttaatcaggcacagctttggttttagaaaacttaagtgggtcaagaacctagaaatcaacaagaataatgagaagatgggggatgtattagtccattttgccttgctataaaggaatgcctgagactgggtaatttataaagaaaagaggtttatttggctcatagttttgtagactgtacaagcatggcatccaacaaagaaggtaaaatgagtggtttctcttagtccttttcctttaggtaaagtatcctgagttctttcctccatggagctctttagacacattttcttgaagggagagatacctggagaagaaatggatctaaaaaaaaactactgtgaaaagccactaaaggctttctctggcatccggaaacactaggctactgttggtgctagagaaagatataaaaattgaaaagatagatttttaaaatgctataaaactcatcctttatcactaaggctaggttataaagagaccttactatgcacataatccaaacatcatgaatgaaagcgtattataatggggcaattcaagatgctatcttttgatttgaaaacaaacaaaccaacaaaacaaaacaaaagaaacaaacaaaaccccttggcttgatttttaattccagagtgcttgttataacatgcataatctcagatatgtgtcaagcaaaacaaaatgactgagcagttatgctgagagctgattttagctactgtacaaattcaaagacatttttcaaggcaatacttaaaagtccatgcttctaatatctttaattaccatcttcctgtcaatactgaaaaaaaaaaatcagatacaaaatcagacctgagaaaaaccaaaggacctatgtttattaattaatcaccatgtttttactttcctagaacttctatatctacgctccaacttgttccaccctgctttatgcttttagggatcacatcaaattagttttcttgttctctgacattcagttgggtggagccaatggaaaaaaacctactggaaatcaacaagaatgagtgtgaggtgaagatatttattttccttgctcatttcctgtttgacaaaattaacaggggctccttttctctcctgaaggctactcctcctccatgccagtaatcattccctcctgctgtatcttcaggcccaagtggtggtaatggctccccactgttgctagtctggagactctgttgtgccttgttagttccccttcttaatcctgctcatacaattgccagtatgccccgtattaagctttcctcagtttttccagtagagcacgccatctatttgctatgctgaccctgagtcaaccttattttttttcactcttacttctgattgaacaaacagatttttatccgttgttttacaacaaaaattgtgtgttgatatcctgtactgtttaccagttgctaccagtgctataaagtgaaaagagatgaagaaagataaacaaggacatatatagtaggaaggacaatttgctctgctatggtttttaagctatatttaaaggatatgtgtatggaggatatgtatgcgtggtactcaaaagacatcctgagagactactgtacaaagagatgagcaaaaatatttcatatatttggcaacaagccttattttcaactatttctggagtgtctccatgttgattagcctgcttagagcctcctatgggctgtctactcaagatttggcatatggaggaaaatcacatgattgtgcaagcattttgatgaggtagagagagcctagagaaagacagaccatctgaacttgagaaaaagctaatcatattaagtgataaaagcaagatataacaggaacacttttatgctactagggaaagtataaattggaagaaccattctggtaaaatatttttatctaataaagttgaattttgagcacgtcctgcaacccagtaattgcactttagatttagaccctaaggaaacacttgcacattttcattaagagatatgggtgaaaatgttcataccactgttgtttttaatatccattgatagggaagtgttcatactaatgcttttaaacatccattgatatgaaacagataaataaaaatggtatattttcaatagggaataccatatagaagtgaaatgttcatatatttcaaaatggatgattctcataaacaaaatgttgagtgaaaaaaagttgcagaagatttcctaaagttcagtatcattatttgagagtcaccatgccagtgtagcaaaaatataaagaaaattgacagagcagtcactccacattgagaagagtgtccactttggggagtgggatagagaaggggatagtgttggagagggcaatatagggtgcccatggggaacttcaaatgttgcatctctcaagcatgattgtgagttcaggggtatttatattacccttattcacatatctcacgtgtgtatgatattcttgttatatataaaataaccaatcataaaaaggcaaaagcaagataaacttatttgcagtaagtcaaacttcatttttatatgcatatatgcatagaacaggttctgaaagaatttaaaatacaatattttagctcattggatcatgagatcatggtgatcattttcttatatttttcaaattgtccatcataaatagaaaagtatacttttaaagaaaaaaggtatagccagtaataagtagcaaatacttgaaaaaaacaccaataccttcaatcaagttctagaaaagttattgtattgaatctcattgatattaggattcactgtaaagaggaaataccaaataaaagttcagacacatgactaaaaggcaaatgaaagaaggaaatgttcccatgagccaatgagaatgtcaacctcttgcaacaattatgtcataggagaaaaaatgtcagaagaccattataataagaaactgcttataaagctgcggaaggtgaccttaatcgtccagtcatgttcagttcaaaccattatttggctttcagctgctatgtatagcatctgtgtgatatagtcatgtttaaaggggctgtggctgttcatttacatttgcaatctctcctttaggctgttattaagatttcacagagtttgcaaaacgtctgtcccctgagaccttgcaaaatgagtggcaagtaaaaagactttttgatgctcaatgtcagggaggacgattcacctagctgtgctacagtccagaaacaccaagacctgttattacaatcctatttaataacaaatatgccagttattgaacttatattaactctctgtataactgaagtatacacaattgtatttattgacatactgagagtggtgtttgataacatcatattgtttgaaacaaacaaggcggtgcaagtgttattcattataacacaatattcaatactgatatttagatttgagtcagaaagcatgattttaagactgatgggctccctgtcataaaccttaccttgtgtctttcaaaaataaaaaagttcttggttagcgtgaccccttttctccataagcatacacgtcttatctttctttaaccctctgtaccatgtattgtttctactaaagatgttaataagtgagatttccagtcatcactgtttttctggtagttttaggtactatgtatatatctttttttttaaacgcacatggtctcttaactaaaactcaaccaaacattatatcatagcttgagacaatgtgaagcatgctaggaaaattatttgtgaacttaatataattaattttgaaaaagaaacctagaaacatgataataggcttcatatatggtttcataaaatcatagaacatctggtttggaaatggtcttaatggtcggttagtccaaccattcaccccgggcttaaatcccttctaaaacactccatctattagtctctatgtcatccctgaactgcctgttccaggaaggaagaatagaagacttttggaagcattccatttaaaataggaggtactaatttatatatccatctgtgcatacaaaatattactccatgcatttactgctccttattttaaatgtggtatggcatacattactggggaaaaaaaatccttccctagctttcttacacatattcctttaaaaactaatttgacagatcctggagctttctcttctttgacccccaaaatgaaatagtgtcaaagaacctagtttctaggacacatgcgaggaccttaaaaaaatacctcaaatgaatcatcattttcatcttttaaatttattttgactgcttgtgtttggtccaagcaagtcaaggcaaatagtcacacagcttcttgccaagattatgttctaaataagagaggatacttgcaagaaagacacactggaaaactcaaacaatcctaaaaaagctgtgttttataagaaaatcacacaaccaccagatgatcaccattagctgttaagatttaacaggacaattctaagtttctgtgtcaaagaaagtttcatggagaagtgattttagggctcttttgcctctaggtacaaaaagtgcttggcaaatcctaaggaataatgcttttttaccctaaaattttaacttgcagcaatgcttgaaatcaccccattacagaatcatagctttggggtttagaggtctctcagttttcaagatcccctggcaccaagctcctaacacacacctattatggtgtaaagctttactgagggggtgactggtctggaatgaaatgcccaataggcttttgacagatagcagggatctcagatactagaagatacagaaaggggaagagggagattaaagataaacttcactccttgctcagttttcccagtgcttatccttccagtgtatgttaacttatttattattacctttggtttatccttaaagtcttcttatagacctacctgaggccagggcaaagatagtcaaacacttttgttgatccaaatgtatgtaactatcttttttcagggattatatctcagtacttacatctttggggatgtctatataaaatttatatccaatcctgagtagctttaaggagtttttgttttctgttgctgttgttgttgtttgtttggttggttggtttttgaaatggagttttgctctgtcacccaggcaggagtgcagtggcgtgatcttggcttactgcaatctttacctcccgggttcaagcgattctcttgtcttagcctcccgagtagctggaggtgcccgccaccacgcccagctaacgtttttgtatttttagtagagatggggtttcaccatgttggtcaggctggtctcgaactcctgacctcaggtgatccacctgccttggcctcccaaagtgctgggattacaggcgtgagctgccacgcccggccaggagttctttttaaattagcattatactgggcacatattaggtgttttataaaggtattttactgagagtagctggagaacatttgtaatggtaagaaatagttccatagtgagtcatttacccagctactttccagtttgaagaattaagtgggagtcattaagactgaatcaatttctatatatatattttcacttctaaattggcaaaagaatctgagaggaagaacagacttcaaaacgactacgttaatagaaacaaatgagctgtttattttacacgcagttatgaatattataaatacattattcatccagcagctgaaagacttatgtcacttaagtgcttgggatgatcaaaagcaaagtggtttcaattattaaaaatggggaggtagggagaagaaaccagaaaaaagacttactaaatgatgaagtgctgtactgtcataatgaaaatatgtaggcctttctaggtcataacattttaagtgaatttaaacttgtaagtgctaagaaataagtaaagtagcaagtaattctatattgcatagttaacaataatttactgtatatttcaaaatagctagaaaagaaaatgtgaagtgttctcaacacaaagaaacgatgaatgtttgaggtgatgggtatcctaaatactcttatttgatcattacacattgtatgcatgtatcaaaatatcacatgtactccctaaatatgtacaattattacgtagcaatacaaataaaataatccagtaaaatgagttggtttttgccttcatcattgtcttatcttggggtttcccaaaaatcagcatctgagacaaagactgccttgcctctgaaggttaagtgttgcttttggcctctaccattccggaatttccctcttttctccattgatattaggaggtccaattgcatggcagcatgtctttctgtctaccctagccttcagaggacatttcgttgatcattgccatttcttattgcctgagtgaaggaactgtcctatgacccctctggggaatacggtcaggtggtgggttcactgttatcacaaaataaatctattctaaccttttacttccttaagccttctgcactgttcaggtattcctgtatcaccaccttgtttactccaggtaattactgtaccaaaacttcaaaaagctggctgggtgtggtggctcatgcctgcaatctcagcattttgggaggctgagacgggcggatcacttgaagccaggagttcaagaccagcaagggcaacatgatgaaatgccatctctaccaaaaatacaaaaacttagtcgggtgtggtggcgtgcatctgtggtcccagctacttgggaggctggggaaggaggatcgcttgagctcagggggcagaggttgcagtgagctgagatcatgccactgcactccagcctgggtgacagagtgagaccccatctcaaaacaaaacaaaacaaaacaaaacaaaacaaaacaaaacaaaaacacttcaaaaaaagccatctcagagtatattagagaaaaattcaggtgtccttgtcaatactttgaaccccaaatcacaggtgactgaataaataaaaatataatagtgttgtacttgtattctatttttattcacataaatatatatttgtgaatgaagaatataaaggtcattcattcttcgggagtagccaaatattattcttggataaaacatgtaatgtcattgttcccaaacttgtattccattgttttggttacatgtaaaactggtgttactgaatattgctttggcattactgctacaattcacgtttttgagaaacaaaaatacagaaacttcccttcgaaattactgtcagagtgacgttgaggacaatgtgtttcatatcctgtaacaagctgttcatcaggactctcaagagaaatatctcttcatgctcatatcaggaaaagatggttttttgtgaaacaaaaccttaaaacatattacaaaaacagtcaaccttgcaaataatgcagttctttttgctttggctactgggaagctcagagccaaatctacattctacttctagtgatttaatgggattttacagtaggcatttcttaaactaattgtatcttctggttttattttattaatccactcttatttccttttccattgatctgttcaacaatttgtattttatttattatttatcacgcaagcaacttcaaggccttatttatacttacataggcataaattaatctagttaaaaacaattgatgtagagagctattgaatgtactaccttacattttaaattaaatgagagatgagcttattgaaagtaagtgataccgcagaggtggaatgggaaacttgaagagcagttttacgttgatgaagagtaagcagctctcaagtcattaatcagtaaagtatacatttattatttaaaaattacagcactggtaaaatcagtaatatggcattagactgatattttgttgcactgtttcaagtcacaataaagtttcaaagaaacgaaatactgattttactttacatgtctcattttctgcctaactatttaggtcagggaatttgtctttacttttaaaaagtgtatccattaagaatactaatactgaggctatagtctgagtttatttaatttgccaattgaaataattccatggaaaactgtcaaatgtataattctggcacataacagaattaaccttatattacaacaaacaaaactcattttaaaaatcaatgaaacccatattacagcaaaatataaggagataaattaaaaatataaaatattattagaagagcttgcctagaaatgacgagctctattgaaacactaccgcacagccagttagaacatgtttatgcttaagaaacgatggaaataattactaaaaagaatgacacaaagaaatataaacaaggatcataaagcagaagaagactgaaaacaatgtgtatataattgtcggaatatcagagtgctctgaacttttaaaatcctgaatcatccaacaggatgatgcaacaatattccaatcttagaatgggaggatttgacaaaaccttagtgtttatcccaagctaggggttaactcccaggggaaattatgaactaagtgcagcaattaatcatggtgatgagtaaaaaagtacagtaacatctctgtgaccaactcatgggagtgtggagaaagtccctttggcagctgtctgcccagctaatggtacttactaattaatggagaggccaaatctgaacctaccctacagccttgtgctgaaagctgctttgtagctattcatataaatgtagactggtccaggtcaaaatacagtaaaagtgagggcactttttgtctctatgtctctggaaggaataataaaagaaaattatcagtgagtcacatgaggctccataatccacgatagactaaacagtaaatgtggccttttcctagatcagtgtgattaattcaaaagtcagaaccatctgtagcagttttaagaacagaaataaatttataaaaagtaatcataccttttcaataaaaagtaataagtaataccttttaaatatatcttttatcagcatttgactggtagcagccatttgagtggctatttcatgcaagcatttatcagccattccggaagaggtgggttgcagtgggggcagaattctggtaaccaaagaatcatttattaaatggttccattcttgatcagtttagcttgcttatagtaatcacatcaattatttatggagcacttaccatgtgctaagacatgttttcatgtgacattttttcacttagttaccataatcctgtgaagtgggtgctaccatccttcccattttccacttgaggaaacaatggtttagagtggataagtacaagcctggtgtatagaagacagtcagaaagtgggattaaagcgtgggtttatccccatggcccacttaaactcttatgtagttacttacatggatactgcctctgaagccatgttcagtcagttctccagggagctccattcttgctccttgaaaagtcttggtagtatgctagctgttctattccagaatagaagcttctgtactattccaaagaaataagacatgatttacaatttcatacatggtaaggcatacacctacctagtttccaagataacatctcctatatctttttttctcctcccttatcccttgtcaaacttgaaaactcaattttagatcagaaaaggaccctagaggctatcttgtctggccttctgattattttaaaatggtaaaaccaaggtcaaaagaggttaaatgatttcgagttggtcagtagggctccccagtgtctggagtccccatctagtgctttgtcccattatcttacagtagttttcatctctgccccgtatttttccaggcatctgatgcaggaaaggtatgatgaaaatgatttttttcagtctagtaaaggaaactttaccactgacatttggactgctctcatggtataacagaaacactgacacaggctttagcaagcttctctatcgcaaccacaggctgtgactctggacacaaacagtacagaaaattaatctcaattctctgtttgaactaaaaggaagaaagcaaacacatgaacgtgtcagaatggggagttaacctggagaagaaataagaagccagataaaaatagaaaagcaagaaagaacttaggaaatatatagggaaatatcagcagtataaatcagattaacatgggacccccccttgtcatttttaggtttaacatttctgatctgtcagacagttttcctatcgccatttccttctgcttccctgcagcccttctttctgacaccacttgggaaaataatctgtaaactaattactaattgacataagattaactaaaaagagcagtcacacacacatatgcacatccacacataaacttgtgcctatacactgtataagtcatgtaaataatcacactgtaccccataaatatgtatagttatatcataaagaattttaaaagccccaaactccacaatttttagacactttagatgcctactattgtaatacataatctttcttgcagtgtttcacagggttctactggtattttgggtgaaacaattattccttggatagactatccacacgtgacatgatcattatcccttctgccaccaaatcccgttagttgcagttagtcatcctgacaaccagaaaacacccttaggcatttccaaatgcccccagggtggggcagtactttcctaagtgagaaacactagggctgagaacaagactctaggtccaactcagaggaattattaacatagattgatatattttattcaagacatatttactgagtgcttgccatgtgtaaggccctatggtagctggctgctaggtgctggggggtacattggtaagtccaaacaaataaggattttgctgtaatggatcatgcaagatggtatgagagacacatattgattaaatcttcacacacacacacacacataaattataaagttctaataatagcaacaaagagacacatagtgttattagagtctacagaggataagttagagaagattccctgaaaaagtgatgcttgagctgagatctgaagcataagcaggagtttacttggtgatgacaaagggcaacaacattgttggtagaggaaacagcatgttcaatgctgcaccgatgacacagagcacggcatgtaagagagatgaacaggaggccaatgtggctacacctgagagaatgagagggagctccctgtgagatgaggctgtagacataaggaaaagccagttcacatgtggccttggagcctagtcaataagtagaatacccaggcgtaactaaccaagtgaaagctggtagaaagcagaaggaagtagattacataaaacattgattgatcagcgggtgttgtctcatgaaccttttaatcaaatcagctctcatctggatggaggtcaagtttgcacagataaaaaatatcttcagtgtgttgtgattgtgtagaatgtactcactcaacaaatttggtaccatgcaaggtcctatgaaagttgtaacatgtaagactagatatctgttggggaacgttgggggaatctggtgacaacctggaaaggtcaagtgtttcaggggaatgaacactgaagttgaagcttcaggaactgggtcttgctaccagactttcttgcctcatgggaactccaccagtccctgatcagaattttcatccctaaaacaaggacaaaaatacccaagtttctgggcaagattaactgaactatcttaagggagaacatctaacccaatatagagtacatcccaagtgcacaattcatggttttaacaaaacaaagtttcttcagctgtaaagtaaaggtcataataacttctctgacactccaaggatgttgtcatcaggccaaatgggaaaagctggtaaagaagcacaaggtattactatcatcaatgaataaatgtggcatgaatggcaccctgaacttaacatcccttgttttctctgttgtagaggcgaactgctccattgaatacccttttcctcttagccctcagaaaaatcacgggtatgggcaagaagaaatgatgatatgcagtttttgatacgatgaaataaacattactgtgataagattttaagtgctataaatctacatgtacacaaattttctttggacgcgttgcagaaaacaaagtattgtttccaaataagcctatggaccaacattttgtcaaatgttagctaatcatggttcttttttaagcaaatccagtttacagcaatttgcagggtgtaccaatgctggggatgctccgcctcatatcccctcagcccacctttaaataaacatgtaggtgtagtgaacacttcctagtatgctgataactttccactgcaagtgcctgttttcactgcttctccatgcaagggctttctctgcaactgtggcagcttgcccagcctgcttgttgggaagcctagaagcctctgaaacttaaccgccctagggattacccgcaacccataatggctgagagttggcagataaatatttcatattactttgttctctgatggaattattctgaagcacgttctacatggttgctcagagggtcctcaataggactgaggcctaggagtccactgagataacctgcttattaaaattcttttagggatttttcccttctctgtctcacttcccctgccttcttgtatgcacttcttataattaactacctgaacccacttcttgtctcgtgatatacttttgggagaacccaaggttagacatagaattcctggaattgttcagttcataatgcacaatttccacttacaatggcacactgatgactactctaaaaaaaatggccctgttctctgtagaaagaggagatacctacttttaaacatctcttaaggggaaaagtctaaaatcaaggatacatttcatgggagggtgagtgtgatctgtttagaatatcagcatttagattttaaactgcatttgaacattaggccacactaatgcccactaactttggagggtcatttactttaaaagcaactagttgaaagattaagtaatttaatttgatagatggctttgtgcctgaatgtgctttaacaccttttgatcctaattgcctatattgaaggtgttaagtttgacttgctaaataaagcctagaaggagttaacatttcatttgagtgacctacaaatgccccccagccaagcctcttggagtgcttctaatggatgctaaattatacaacccaagtgattagctattttagatactgaattagtaaggatgctagaccataagctcaatgaagaaaagagctgtacttatcttattcacctttctaccttaatatggtgccttgtacttactaagtgttcaacaaagttttcttgaataaatgaacacatggcaacctccatttaaatgacttttattattctcatatgagttaagatgggagaagatttggcatttaaatggttggcaatctaaggagaaaatactatcacgcatctatcctttatcttcagtgtgaagttataaagtcagaaagctaccccactcttttctggtccatttacatattcatatctgggaagtgagaagcaagagaaagttgaaagactgcaagatgtaagagtgatccctaaaagaaacacttcacccatacaaatacttgcttaaactcactatagtctgttctttcagaagaatccgcgtgaaggaatcatgggacttcaggtcagaatgaattttgtaggatattctttatgctatgctaggggaaaaagggagtttagacagtatcaacttcatactcgcagcaagtaagcaacagctaatcaatcactagagatcatcatcttttcttggggtgaacacatattatcttattggtttacaagtggtgtacctcggttaattttagatttgaggtcagtctcaacgtagcgatgacttagcaaagtgcaaaataataaaaacctagcaacgtggacatgttttgcataatcattgaatttctataggactcaggattctcccagattgtatatcagtcctgacttggtcttgttaatttttgatatccaccctccatccaaatctcattccattagactcggaaatgttgaaatgttgtctgctaatatctgggtaatcattcttctgtgctatataagactgtcagaatttgtatttttgctgtgatgcttgctattcccagttcacagaaacctaaagtgttatcatcaacatctgacagtatgaacttcagggtttgttagaaaaaccacttaagtgtgtgagataaggaaaaggagaaacaagggctttgacttggctgtgtatagatagtgaaggaaaactccataaatggaagatccaatcattttggaattttacttgaagagaaattacaaaacgtcagcaattttaaagcctcaattcctgacgccttctatccagttcaatcaataaagctatgctttaactggagctcaggacatcctgggaatatccagattgtctctctgattctctgccactgctctgtgaataagaactgccaaagatttcttacatcgttagcactcactggcccactctgacttgctcttctggctctttacgaatgtatatgctttgcctgaaattggaaagcacttgctcttaattttctctgcattaagcaagtgtttccctggcagatgcagtttgcgcaggcatatttttaagcgctccccctgctggcaagtctgtgtaaacagtttgttggcctctctaggccctggctactattaaagccacttcacctgtcagcttaggagagctgtctgtgattccataaggccccagttaggcactcacatttacagaaggacaggagcagcaatttagcctttaactattagcttgccataacagattgcattatcaacagccgctccaacactcagaatgataagatgcaacctgggttcatttcaggggatgctgagggcctgctgaacatgccaactttgccttataggagataaaaagcttctccttcagtatctgtacttaacaaggttgaccatcttgcttttgtctgctttatctcacatacttttcttatttaataagcaaatgtgatgttaataggtattaacattggcaacattttcagtttttcttaagtggttttaaaaaggatcacagaaaaaggacaaagtctaaaggttgtgtactagaacacaagtaggcatgctttgcatgataattaaatttctataggactcagtatcttcccgatatgtaggagataagtctgaggtatttttagaaaaaacaggctgggcacagtggttcacgcctgtaatcacagcactttgggaggccaaggcgggtggatcacaagatcaggagttcgagaccagcctggccaacatagtgaaacccccgtctctactaaaaatacaaaaattcgctgggcgtggtggtgcacacctgtaatcccagctactcaggaggctgaggcaggagaatcacttgaacccaggaggcggagattgcagtgagccgagatctcgccattgcagtccagcccgggtgacaatgtgagactccatctcaaaaaaaaaaaaaaaggaaaaagaagaaacatttaaaaatctgaggctgatggaataaaatatttatttcgaaagggggcaaaatgttgccagtaattaataacatgggttctccagagtattactaaacattgcaaatttgaatggtttgactttgtttcataatcctttgctgaataaacaaatttatgtatatttatataagaaggcttactcctcattcatggattcataaaaggaagtacatagtcttaactgtaataatcatttgaaggccacagggatggaaatcagcagacctgtgtttatgttctgtcctaaactattttttgtctttttctaaagccacttagtgggcctcgttacccatatgtaacaggcaaagatggtaaatcctaaggcctttggcaactctatagtttggtgattatataattactatagaataaaaaaaaaaaagtagtttgtaaaagcactgcttctactctgtcttcagtcagattccctgaaaggagagcctgagataaggatttttttgtaagttatttcctgagggttttcgggagaaacctgtcaggaagtgggtttagaaagacagggcaggggaaagagccgagcaaagataagattttagaagactagccttagcctgatcccacagggagctctggagcatcaactgtatcactgtttttcccacgttaaagaaagcaagcaaggtgggcttttgtatctccatattgataagacttttgccaaggagcacactgggaaatggaggcagagcttcccagacttttgtgaatggggcaatcctctggagaagtgaatgtgaactgttagcattcagcaccacagaagctagggggtaggtggcctggcctgataaagggaatctggatgaggcacccatagcatctgttgaatactatttcttcttttctcaatctaacttaaatgtcaaatagtattaccaggttacaaaacattcatattatttatctcactggaccttataatttttcacacagtaggcatttgatagataaaagttaaaagaactgcttattgtgttttacaaaaaaggagaagctcttatatagttggaaattacttttgttactatttaatttagataatatattgtaggaaatggttattcgatgagaaagcagaaaatggaactcaacaattaaggcttcctggaaaaaaaagttctctattctttagcggagaatgaagatttaacattaagaatggcctgtcctcacaagtaaaattgaagttaaagtaacctcgaatttttttaaatttctatcaagtgatcttgttccaggaattaatattacacttagacttgatgattaccaggtaaagaacattcattagaactttaacaaaaaaaaaaaaaaacaaaaaaaaaaaaacagagtataattaaggctgataatcatttgtttttgtttaaaaaatacaagtctgcccacagtggtagagatttctacctataaaatgttcccctgaaacagactacttcttgaaatatgaattaggggtttaattcttgtattagtctgttttgcattgctataaaggaatatctgaggctgggtaatttataaagaaaacagatttacttggctcacagttctgtgggctgtacaaaaagcatggtgccagcatctgcttctggtcaggacctcaggaagattttactctcagtggaaagtgaagagggagcaggagtggcacatggagagagagggagcaagaaaggggagggaggtgccagattctttttaagaaccagcattcctgtgaactaatagaatgggaagtcactcgttactgcatcaagtcattcatgaaggatctatccccatgacccaaacacctcccaccaggccccacctccaaccctgaggataacatttcagtatgagatctgaaggggagaaatattaaactatatcagttctttaacactcaacttgtttaaaacatcatgaataccattttaagctgtcgatagtagcatcggccttataatgaagcaagactgtagacatttttttttaaaagggaagctagcagagatcatgaaggaactgtgtataagaggacaggcacagggaaaacggacgtagtgaaagacaaatgtggttgatttcaccatgttgtcttggagagtcttaaaggattttttagtaaaggccttcaatctgtttcaggtcataggcccctttgagaatttgatgaaagttatcaaattcttccctttgggggaggaaagtcctcaaatgccttattactttcctctccaaaagggaaaatgtacatgcacacaacattttgctatcagtttagagtaattatagaacattgaatccctccacaaatcactactgtgcagagaaatattagtatgtttgagactacgagaaagaaataacagggatacaccagaaggaagttctgttctgaatactatctagtttttctttcacttagagaaagtatatctcagttatgatgacgttaatgaagcttaaatgaataataaatacagttcagcatatctaacactacattcacaaaggctttttcatgaagaaaaaaaaggtaattatagttggagttgcattaggaggaccaaagagatatttcacgagtgagtaggctgagatcacatttctaaaccagtaagaacaacccattaggatttgttcacaataaaattctgctttccttttatttatttatttatttattcattcattcattcattcattttgagatggagtcgcgcactgtcacccaggcttcagtgcaggggcgtgatcttggctcactacaacctctgcctcccgggttcaagggattctcgtgcctcagcctcccaagtagctgggactacaggcacgtgccatcacacccggctaatttttgtatttttagtagagacagggtttcgccaccttggccaggctggtcacgaactcctgacttcaggtgaccacctgcctgggcctcccaaagtgctgggattacaggggggagccaccgagcccagctgagccgccacaccccacctttccttttaaagtatcaaatcacactttgcttaatgacttactttctcgacatcattacagcctctctgttaactccagaagcagtctgccaaggaagccctttgcaaagcaaatacttctctagctctcccactcttgagaaacactaagaaagactagtctgatttacactgatactgacctttatgtattccagctctatttttgaccactagctttttgggacctccaaggtcccttgcctcttcctagaacctgttgtcttagtctgtcttcctagaacctggctttcttccatatctttacaaccagctactttgttttgggttatttggagaccacacatctccagcaaggtcttcaagcaggattctggaagcagctccaattcaaaatttaaaaattacaatgtactcttaaggcacagtgttcatatttgaagcaaatctagtcgcttcagattttcatttctatttgaattgcatgtaagaggagcgcttcatcattgcaagattcacttatatgctccgcagtgctcacgcactccatgtgcagattagaagccagactaattcttctttcctcccaaattattaaaacaggtaatgcacttttattaatgttagaatcaactgaaataattctggaaaattaatgctctaagtgaatgcaatttcagagctcggtgagtacattataggcttattattctcactatgtatgggatgttaaatttagcagttttgattttcatagaagactaggaataatttctctatcttgtctgcacgataacctggtcgcttggtactcttcctgaaatgaagaggtagcactgtaccttgcaatgccataatcttttatgagacattcagttaaaatatcacagggcaatataaaaggattttggttattaggttttctaagccaagccaagacatgtagcatacatgcatctctttttctgtctttctctctcttacaaacacacacatacaaatataaataatataccgaagtatatattacaccaagcattgtacaaagtttgaggtatatctatggtaaaaagagaacagacactatctttcctcatggagattgttttctagccgatgaaaccaacagcacatgcagaagcaccgcccttcagtaggaggcaagatgctccttgagacataacaggaaagaagatgagatgcagtaggttcataatttggtagcggaaagaagatggaatttccacgtaatatttattattttccttaagaaagcatgagatgaggtcataatctcggagtaaagaggaaggatccaagcaaggagattgaaagagggaagagaaggactaaactagttattcgaggacttgaataatatagagttactgagcttgctgagggtccgtttaggtttgagctaaggaagttaacgggaacgaaacctgcccggttttacaatcctctccagcaaagtggctgggatggaaaaggtaaatggttggtttaagtaggttagagggttttcaagggaaatacaatgaaatgagatggaagtctttttttacaaaggaccaatgggattaggttagtcaggatgaaagtgataaaaagggaaatggtagataaagaacaatcaatctatcaatagaaacaatggactggaggtaataattgttgtagtttaagttttagagcaaaatatctggatggcaagaaggctacggttaggaagtagaatatttgaacttttgattttggagttagtgcagattttgaggccctggttcaagctggtgtggaggggtggaataggtcagtggtaatgagtatgggtcaaataattcagagtgagtttttagccacttggatgttgaaattgccaaaataataacagtgactggggcgtgaaagaagaatgggaactaggtgataaaattcttcagtgaacgaaaagaatgaccaagaactttaaaggagtagcaataagaaagtagaaaaggccagatggtccgcccctcaaagaataaagaattttatgggttttttttaaaaaaaatacagaacagtaagagtatcaaggtctggaactgcaaatggagagaaaggggagatatctgtcctgaaatgttagagaaagacagtacagctttgttttagaggatgataggatccacaacctttgaggacagccaagtttcagtaaaggtaaacaggtaatcagcctaaagaggttgttttagttgtgccaaatagttatgtgtgtgagtgagtgtgtgtgtgtgtgtgcacacgcgttcacacgcatatgtgcataaatatacatggactttcatcatggctaaagaatttatcatggctaaattcttttggatttcaaaaatttggtagataacaatagtatttcccaatggattattttatttcttaaatacatttgcataagtttcaaccaactgtcatcaggcatacttgtagaatgaaaccatgcattttaatcctttagggtcttatactaaatggcaaagccaatcatgccctgggtcctataaaacacttcttaaatttgtgcttatctgtctcctaagtggaggactttgcatcttcactgatatagaccagtggttttcaaactgagcaataaggatttttagggatatttgtgcattgggaactattctggaagattattgaggtgaagtgggacatcaaacaagttggtgtctggacctgtcccacttgtttttaaccagaacagctctgtatttcttttgtatatcgagttttcacattgtgttctaagaaagttttactctgttttaaaaaataagcttggaaattttagactggaatgatgaatctcagaagatgctactaatctgtgtagagagtgagctatatatagcctttattcttttacttggagttgtcatacttcataacttatcagtgtaatttcttcattcataaacctggtgataataatgcttgcccaaggttgttgagaggtctaatgagataatatatggaaaagtgctttgtttgacataaatttcacggcttctaatcattgactaataagtcagtgatcacttagaggcctggacatactgaggaacaatgatgaaccacaccaccagtccatcctttgaatctgtccttatttgtagaatacaagacagaaataattccgaaatcaaatttctccaaaagccatcttttcaataatgttttaatgctgtgtctttgggctttgtcaaatatctgcatatgaaaaagtaaagtgaaggacactgtgtacctttctaaacccattactggaaacatgatctattatgttgttcagtattccttgtagaaaaaaacatattatagttctttcagtaccaggaaaaaggtttatcccttatgaagaaagtgtaggtttctgttgacctgattatatattctagtgtgttttgctttttgctttaactgcctgaaaattcagaacaaaatctaatgctctgtcatggtatccagcgtcttcctactctaaacctctctcttactttatctgaatgtctctctctttctcagactctctccacacacataaacacagacgattacaatatctatttctagcaccctcataacaaatggatcacttattttccatcttcccccattattcctttatttttaaaggttgaattaatttacatattaaattaatttgacctattacatcatttttatagaaagataactctgaccccttttctctctatatatacatatttttatcaagatacagttgttgagctatttaatttttccatcaacttacttgttcagaagtatattcattgagacacaatggaatgtgtaaatgtgcatataaatgtgtgtatatgtatatgtatatgtgtatgtatatatgtgtgtgtaaaacagagatgtgtaaggcctcaatgaattcacagtgtattttgttatgatatagaaataatatataaccatactatatgctttctaacaagcatcagcaaactataatctaaggagatttttctataagtaaaattgtattagaaaacagtcatatccattttttacatattgtttatgattgctctggcaatacaacaacaaagttgagtagttgtgacacagaaatcatggccctcaaagcctcagttatttactctctggctctttatagaatgttgctgggccctgatctataggcgtttgttagtgtatatatactttcatacttggagcagtggaaaaactgttagtaacctgattagataataactgccaggttttagtctttatcttgtatgtgcaagattgattaagatgttttttactgagcagataatgtggtgttggtagtggggggtgctgtgtctagctcccttagggctggattggaaagggcagtgattgaggggtagatggcagtggctctgtgtgaagtacaaaagattgcctcgagatagctggtacaaacaaataacaataagagtagttattatttttgagcacttaccatgtgttagatgttgtcctaaagaatatccaaacatgagttaattcaatcctcagaactgtcatatgacacatctaacataatagtatctacattttggagatgaggaaatggaagctcaaggagatgctgtaccttgccaatggtcatgtagctagttagtggtggaaataagattcaaatcaaaatatctcatgacttcaaaactcaagctctcacctgagttatacagtgtgtctgctttggggccttgctcagaccctctgaatagtgcctatcacattattataattctcatactcattcattccctgtatctgtgagcacctagaggcagggactccttaatattcatcttggtatatctagtacctagcacagggtctctcaataaaatggcttatgggtatgtaattgaggaagtttttctggaggaatactgcctggacctgccttaaggaggggtaagagtcacctccctacccctatcaccaggcaaaggaaggacaggagtggcccaagaaaattcagagggaaagctttccacattttggaatactcaaaaatttttaagatacaaaaatgtctgcccataaatcgtgcagttggaagctattccctgtattagcataatgttatttattcttatgtccacaactcttctgctgattaaatagaattccagaagatgaaaataaattgtcataataatgaatatttttgtcagctcgatattggaattataaactattcccaattgtcttttccttcacagtaattttcatatgcaaccagaatacagttgcccggtcaatgatattgttatacaatgaaaaccttcagtttagaaacttatttctaaatgtcactattcataagattatattttgaatatgaatttcagtattttctcaggtactggcaagaaatatatatttttcaaaataaattcacaaatttgcataaaaagattaaggaatatataaaccaatatgtcaaatcttttcaactgattctacaagtgatatatatctggtccaataaaaccttattttttactaaaagaaatttaaaccatatttgacccacccatttcagggatggcacacttatttgatatggttcctaggaactgtgaattgcttctgaagtcacggttgcacaataagtatcagtatcttttctccaggagctcattgcaaattagcaattaaaagaaaatgaaagcataaataaatattatgaaataggcagacattatggagggaaagggtaaatcttctagtcacatctacaaaaattaaaaggtttttttctcgaatctatctcttccagaagaataggatctaaatattctaggttttgctaatgcttacttatgcctccaaaaacattcttgaaatatatgttctaataaggaatattaaataaaatggtcattaaatatttgaagtatacttttataaaaaataatattcttggctttttcttaagtggtaaggaaatgtctcataatagaatattctgaattgcaagcgattttacattgtcaaatacttttaatatgctctaaaaatagacattaaacttattatgctataaaatgtaagtaccaccaagaaaaattaagcatgtttgcaagcattaaaaaatccattgtctacaatttgcatagttaataaagatacctcacagcctatttttgttttaagcaacatgaaacattttgtgcaatgtttccattcgcatattctggctacagtcaccacatctaatcttgaaaatgattattttaatgtaacaaaccaatccagtactctcattttgcagtggttgtggctttttacaaatagccttaataaaaagaagtcacctgaagagtgactcatctaggcacgcactgcagaggacacagcatgtaatggctgaaacaaagctaaattgggtacagtggcttctgattagacatgaaaaaaaggctgaagttagatccagctgcacatatttcattaggaaaagcaaacacaaacatggggaatgacttttttttcttttataattaatacattttaaataaatttgaacaaagtaaaacaaatacaacattgtttgagtgagaaagagattttctgtggtagcatgcggcacttgaggcaggtggcttcatgcgtgaccgtaggttttgaatcaaatgaaaagtacctagtcacctattgctgaaaaatgatgctgtgggaactgagggataatgcagaccacaaatttatctccctcaataaaattctcagattctttatatcaatatatattttagtctggactatcatttaccactctcactccattcctcaacggaaacaaaaggaaaatccacatcatgccttgtgatgatctcctcttattaatatgtattagtggtaccagctaatgccccagttatacaatctcggacttgcatcaccttagatttctcctttcccttatatcatttgaataattaaaacctatcactttttcttaaaatcatttaggcagtagagattagtgtttaagttaatgggttttggaggcaggcatgcatcatttgaatccaagttgaacctcctaggaacagtgtgaccttaggtagattcttcaacctcagcttgctcttctacggaattaacaatactcaatggcacagagttgtagcaaaggttaaataaaatactgcttgcctaatagtgaggggcctgaagcaaagaatgcattcagtgatgcacatactgaagatatacctactccttttctcccaactgctcctaggttctataccacacacacacacacacacacacacacacacacacacacacacacacacacacatacatacactcttggatagtcttctgtatcacacatactactttttgtactgggttgagtagtgacccctaaaaatccacacccacctgaaatctgtgaatacgaccttatttggaaatagagtctttgcagatgtaattagttaagatggggttatactagattagggtgggctttaaatccaatgactggagttcttaaaagaagagggagtgaatgtagagacacagacacagagagcagaatgccacatgaagatggaggtagagactggagtgatgcttctgcaagccaaaggatgctaagaattgctggccaccatcagaagctaggagagataaatggaacacatctttccctagagccttcagaaagagcacagccttgctgaaacgctgatatcagactcctagcctctagaactgtgaaaaaatcaatttctgttgttttaaacaacccagtttgtggtattttattacagcagacttaggaaactaatacactctttactcagttaatcagtgtaatttaatttccccttcatctctacccctgtcccaattttctttatctgattaaaatgtaacatccccaaaaaaagagaagagaaaaagaaatagatgggatactgacaaaggtgcctctcatcctggcagtgtgtagcaattacaagtgaaacactgaaggatggggtagacaggaaagctctggtagtggtgcatgctgggaacacagcctctctttaacacactctgcattcccagctttcaccactatgggaaatgatgcaaaataaaatacagttgagccttgaacaacaggggtttcaactgtgtggatccacttatacttgaatttttaaaaacaaatatgttgaaaaatgttttggagatttgcaacaatttgaaaaaaaaacttgcagatgaattatgtagtctaaaaatattttaaaaataaggaaaagttcagtatgtcatgaatgcataaaatatgtaaatactagtctattttatcctttactaccataaattataccccaatctattctaataagttaaaatttatcaaaactaacacacacaaacatttacagaccatacatggtaccatttgcagtcgagagagatgtaaacaaatgtaaagatgcagtaataaaccataactgcataaaattaactgtagtacagactgtactactgtaatgtttcacagccacctcctgttgctattgtggtgatctcaagtattgcgagtatctgcttaaaacgtcctgggacactaatcctctccctgtgagcagttcgtctctccagtaaattgtagatggcagtaaaaagtgacctcttggccgggcgcagtggctcatgcctgtaatcccagcactttgggaggctgaggtgggcggatcacgaggtccggagatcaagaccatcctggctaacacggtgaaaccccgtctctactaaaaatacaaaaacttagctgggcgtggtggcaggcacctgtaatcccaggagaggctgaggcaggagaatcgcttcaacccgggaggcagaggttgcagtgagccgagattgtgccactgcactccagcctgggtgacagagcaagactccgtctcaaaaaaaaaaaaaaagtgatctctcatggttgttgcatacttttcatcatgtttagtgcaataccataaaccttgaataacaccatgggacccatacgatgtgccacaagtgatgctggaagtgcttccaagaagccaagaaaagtcatgacattatgagaaaaagttgagttgagtgatatgtactatagattgaagtctgcagctgtagttgctgccatttcagatagataattcatcaagtaaacagacaatgtaaacttacagtaacaataaatacggtacagtaacgtaaacgtattttctttctgattttcttaatattttcttttctctagcttattctatagtaaagatacagtatataacacacataacttataaaatgtctgttaattgactgttttgtgatcagtaagactttcagtcaacagtaggctattagtattaaatgtttttgggaagtcaaaagttatacatggatttttgactgctcaggggtcaacatccctaactcctgtgttgttcaggcgtcaactgtaattccacttcattccattgaagtcagactaggctagtctattttaatctagacacctggagttagattgagttttgccttatactgtctttctgaggagaccaaatagccaatgatccaaggtaactgaattcgctattgggaaaataaagacttgaatagataagtactcttcgaaatctgtcatgctttagaacacatagagagtgataatactgtaccatattctggtacactgtgaggccgtttttccaaagtagctgcaccattttacatcctttccagtgatgtatgatggttccgatttccccatattctcaccaactcttgctagaatatgactttgtaattacagtcattctagcgggtgtgaagtggtatccattgtgattttgatttacattttcctaatgactcatgatgttgagcatcctttcacgtacttatgaccacttacatatcctgtttggataaatgtccatttaattatttgcccattttaaaattagattctaagaattctttattctggataaaatccccttatcagatatatgatttgcaaatattttcttccatcctgtgggttgtcttttcacttgcatgatggtataatttgcaacaaaaaagttttgtattaattttgaggttgtgcaatttatctattttttggtatttgtgtttttggtgtcatatctaggaaatcattggctgaaccaagaaaacaatttttttagagttttatagtattagctcttatatttaggtctatgattcattttgagttcagttttgtgtatgacatgagttaagggtccaacttcattgttttgcatatggatatcagcaccatttgttgaaaagattattcttctccattttattttttgattgtggttaatacatttgaaagaatgtcatatgtaaatttatggatgagtattaaagaacagggctataagattattgggaacaaaattcctgtttattaggaacaaaaattaaaatactgctccagtgagtttcaattttaggcaacttaatcaaatttaacataatacaaatagaatatgaattattagaataagaattgaaactgtctcaacactatgaaaaagaaataaattatttaaccttacgattccataaaattattgttttaacaaaggattataatgaaatattaacaaattataacacactgcaaaagaaaatgctaatgaattttagaagtgccttgcatagagttaaagagattaaaggtatttttaattttttttattgtgaaataatagctacttaaaaaaccttcctacaaggaaacttcaggcctagggagcttcattaggagaagggaatgtcactcatagaattttccactttcatcgcctttcacataaggtcgggtctcaggcactgtgttaagcatccagaactcagataaaaagccaccgtttactgggttaataaaccacaggtcagaatttagggtaaccacagcaaatggaaggtaaaaattaaaatcttgacaaagagagccatagaggggaagatccaaatgctgcatgtataatctcagcacaaatttctgactgactcctgaattatgtgtactacacatgtgcaggacagactccaaacagcctggctaaagctaaaaggagtgacagagatttcagttactgcctatcacaagaaacacagtttggaatttgagttcaaccaagttcactgcccacttaaagcaaaaaagaaatcaacactcttcaggggaacatgacagaattcacagtctataagtggtatcactaataatgttgagatgcaattcaaaattactagatatatgaagataccgtagttcttaaaactgttcaataaagtgagtgaacatattctcatgatagacaaaagagaatttcaacaaataaatgacaatttaaaaaaacaaatagaaattctagaactgaaacataataactgagctaaaaatcacgtaatagaagatgggagataatataaaaagagtcagtaaattcagagatacatcaatagagaatagctaataccattggttagttgtagaataatgtaacaaatttaattatgtgaatgtggagtcctagatggagaatagaaagaatagtacagaaaaaaaatctaaaaaaacttcaagaaatatctgaccctacctcatccttttcaaaattgttgtagctattcctttgccttttcatataaagtttagaattctcttgtttatatacacaaaaatgttgaacttttcacagaaattgaattaaacctgtttaacactttgggaagcaatggcactgttactatgctgaatttcccaatctatcaacatggtatatcctccatttacttagatgtttttttttatttctttcatcagagttgtgtagctttcagcatgcaattcctacatatttattgttaaatgtatacataggtatttcatttttgaatgaacataaatgatattttgttttaaattttagtttctacatgttcattgctagtctatagtaacacaactgattttggtttactgatcttgtattctgtgaccttgctgaagtaactttttaattataatagttttcatataaattccttggggatttcgtatatagacaatcaggccatctgcaaacagggacagttttacttttttacccaaacttgatgcctttaaatttcccatttcttgtctcattttgctctctaggatttctagatttctagaattttctaggaattctagtcctagagaacaaaatgacattatgttgaataaaattggtgagacaggacatcctttcttcgtttccaaggggaaaacatttagtatttcaccattaagtgtgatattagcttcaggtttctagtaaaatttctttatcaatttgacgaagttcctagttgggtgagttttttatatcataaatgggtatgggattttgtcaaagtattgctctgtatcaattaacataattatgtgattttctttagcttgttaatatgtgggttaccttgattgatttctgaatattgaacaagccttgcatttctgaaataaaccccactttgtcatggtgtataattttaaatgtactgctggattggatttgctaatattttgttgaggaattttggatctatggtccttagggatgctggtttttgttttttgtttctattttttttattgtcctgtcttgttttggcatcaaggtgatattggctttataaaataagatggagattcttctcctattctctggtagagatagtgttaaattggtgtaaattcttctccaaatgtttggtagaattatccagtaaaattatctggacctaaatatttcaaatgacattatatcaagttaaaaagcttctgcacagcaaaggatacaatcttttccaggactttttaaactaaaaattcattttctttaatagttattggactattcaaattacttcatcataggtgagttttgtttggtatctctcttaaggatcagaaattttactatctttgatctattcgtatttctacatctttccctgttaatttgggtaatttatgctttcctagaaaatggatcagtacaatcccattggctctctgcttcagctttctctaagtcttcttgtctatgtgtggtcatctgtcttaagttatagatgtaggggtttgtgtacacatatgtaagtgtatatatgtgtgtgtatgtgtattgatattacataaatacatattcagtgtttaggattttgaatgaatggaaagaagggtagatgtgttagccttctctgctatttgatcaaatactctttatgtttggccttagtctgttttcttagtgtcactgatatggtttggccgtgtccccacccaaatctcaccttgaattgtaataatccccacatgtcaagagcagggccaggtggagatcattgaatcatggggacagttttccccatactgttctcatgatagtgaataagtctcacgagatctgatggttttataaatgggagttcccctgcacaagctctcttgcctgccaccatgtaagacatacctttgcttctcctttgccatctgccatgattgtgaggcttcccagccatgtggaaatgtgagcccattaaaactcttccctttataacttacccactctcaggtatgtctttattagcagcataagaacagactaatacagtcaccgtcctacctctttctctatggtgaaatataagtgctaaggccaatcctaagcgttgcctcttttctgaagaccttttcaattcttctagtagttggatgctcccttaagattttgccgtcattatcattgtatttttcacattgtaatgggataatggcttttccacactgatgtcctcagtaggctttgaaccccttgatactagggatcatgcaattcccagtttgcaattccaaagtatagttctattcagttatcaaggagtctatcaatgtatttattattctgtgtataaacagtgtgctttttcagtaaattctcttgtgatataactatatagacagatgcattcttaatattaatttaactaatttgttaaattttattcttatcttatgctgaataaccacagtcagtaaaatagtttccatcaaaacaaatgcctttatgaaatgtggattatttacttgttcatgtagtgcagctgttttataaccagtgtaaagaatttagtaaactaccaaggatatttagagtgctaactttatggctgggattcagtacttgcatttaatttttccatgaaccatatgaactctcagttatgactagaactagctcagtcactgggtaactaggcatttgcttagtgagttcaggggactctgagatcctgggacttggaggtattccttacacgagaattagcctgtatggccattttcttacttctgtatttgtttatccctaatgtttagctgtacatggagcattttatctcatcatatttgatggccatcatgtatgaaaataaggcaaattaaatataaactttactaacctgaactcttgatctggatttctagaaagactggagcatattttctgaaaacagataatgtggtaaaatattcttacaggtgctgattttaatgaggctaacaaagtgagggcaattagaaaattttaggcatatatatgaataatacatgtaaatagtactagtaagaggctcgaagcagattaatatgttaagcaggtcaaaagatactctttataatctttcatggcatttatatatttggtaatatatttttatagtcagagacaatatgaacattagtccagggaagcccttatttaaattatcacaaagtataattttgaggagttaaaaagataaaaactaagtatattacagtatgtttgtgtctactaaaattataatagtttatctccaccttcatctgttttacaaatgagtaaattgtagaaagctgagaaaatgtagctaatatcatacaaatgcttagagtaacaggtagaatcaatacttccaatatattttaaattaacaaggctctaataaaataaaaacctgcctagtctaagaaccttatagaatagcttctcagagcactcacattagcctcctgttaaattctttaactgttaatatttacagcagctgaagcgtaaagcatcccaatgaatgaaatagcattatttagctccccaaacagtcaccttcaaggagaaaacaaatcagcccaattcaataaaaattagtagttttctgttttgtaaatgtaatatggaacatttattgggtttgttctaattgacatttgtgcttgtaattcccccagagaagctcttttgttaaattattacgaaaggctaccgggtctagaggtacggtggaattagcaaatgcttcaaagactaattgggtttgaatactgctgttcagtaatctattcactgggtgaccatgaacacattaactgacctctgtaaaacttagtttatttgcctgtgaaacggagttataaaagtatctgactttgttggattgttgtgaacaatgagaaaacatttgatttgtagtgacatttctcatctaatgactgtgtaaccttcataaaggtagagtagtgaaagggaagagaaaattaaaactgagtcaggtattggctattctataggactcttccctccttcaaatggtttcctctcatatatagaaaaatagaacagtgttcagataataacatattgctttgaatcaaagatgccagtaattgcaaaatatgtcctaactacagagaattcaaattgtgatatgatgtgggtcttggaattgatgattttcataatggttaatatatattgagcatttacaatatggtaggtactgttctaaatgttgcacatatattaacttatttattctttatctaaaaaatcaagtaactattattgttatctctattttgcagattaagtaactcctccatgagcactcagctagtacaacttctccagaacactgagctatcgctaaagaggagctgtggacatctaatctaccaacatcaagcaatagccaccaccaggagaaacacacctgaccctgtaagattcttttacataggagtcacgggtgcggggaattgaagaagggggaaattggggaatgggaagtagtatcattttgtgttgtccatcatgctcaagtgcctattaaaaagcctgcttatttattggtaatgactagtgttagagagtgctgaaataaatgtaaccttataagtgacttaaggagacttgaaaccgggaaccatcactctcagcaaactaacacaagaacagaaaaccagaaaccaaacacctcatgttctcactcataagtgggagttgaacaatgagaacacatggacacagggaggggaacaacacatactggggcctgtcggtgggtacggggacaggggacggctagcattaggagaaatacctaatgtagatgacgggttgatgggtgcagcaaaccaccatggcgcgtgtatacctatgtaacaaacctgcacgttctgcacatgtatcccagaacttaaagtgtaaaaaaatttgataactttccaaaaaaaaaaaattatcccagtgaagccaatccaaacttttaaaagtacctcactaaggggcagttgccaaacccctggcaatcactagtctgattatagttttgccttttccagaatgtcatataaatggaatcacacggtatacagtcttttcatattggtttatttcactttgcaatatgcaactaagaataatacatgtctttctttggcttaacagctcattccttttattactgaatattattctgttgtacagatgtatgatgacttatttatccattcatctattgaaggatatcttagttgcttttacacattttcatctatgtgtcctgtgttacagccacttcaaactatcttcaggtctctgaatgtgccgtgtactttaattcttctgttccactgaccatgttgttttctctgtctggaacttcctgtatgcatcctttcactctactgcacacctcacgcacagccagattctactggatgcccttctcatattcttttatactattgcttatcaagcttcaatgtgcaattagttatccacagatcttttaaaaatgtagagcctgattcaataggtgtgcggtggaactcgagatttttgcatttctaaaatgtgctggggatgttgacgccgtacataacacactgtgctataattgttgttttccttcgttatctccaccagacaaggactttcttgaaagtgtgaaccgatatatatccgcattgaagaaaatggagtcaatagttcctccacttgacttagaaggcctttaacaaccttgtcccaaactaaattttcagacccatttcccaccacccattcctttcagtccagctgttattacttgtcacacacaagtcccaatgtatcttacataaatgaaaatataattaatttataagttataaatctctaacagggcaagttgatgggatacacatactgtttactcatccatgcatatataaagcaaggtcatagttctccattttgatgggcaaaccagttctattaaaaaatatgcattgtcaggaaacaacaggtgttggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacacatatgtttattgcggcactactcacaatagcaaagacttggaaccaacccaaatgtccaacaacgatagactggattaagaaaatgtggcacatatacaccatggaatactatgcagccataaaaaacgatgagttcatgtcctttgtagggacatggatgaagctggaaaccatcattctcagcaaactgtcgcgaggacaaaaaaccaaacaccacatgttctcactcataggtgggaattgaacaatgagaacacatggacacaggaaggggaacatcacacaccagggactgttgtggggtcgggggaggggggagggatagcattaggacatatacctaatgctaaatgatgagttaatgggtacagcacaccaacatggcacatgtatacatatgtaacaaacctgcacgttgtgcacatgtaccctaaaacttaaagtacaataataataaaatttaaaaaaagaatatgtaaaattttaaatttaaggagcaaataatgaacaattattgtattcatgtaattttgtccttaaatatatcagttggctaattaaaaaaaaaaattacccacacacacacaaaaaaaagcccaggaccagatggattcacagcagtattctaccagacattcaaagaagaattggtaccaatcctcttgacactattccacaagatagagaaagaaggaaccctccctaattcattctatgaagctagcatcaccctaataccaaaaccaggaaaggacataaccaaaaagaaaactccagaccgatatccttgatgaacatagatggtatactacaaacatatgtaacaaacctgcacgttgtgcacatgtaccctaaaacttaaagtataataacaaaaaaaaaatgcattgcacacttttcagagaagcacaacatttagtgtttaaaatttcccttttccttccttatactgaatgggcacacacagtgaatgacagcacagaacagagttttctaacagatttccacatggctctccaacttttaacagtgtaattctctagtcgtccatgctaatgcatgtccatagaagaaacacagcccaaaactaattacctaagaaaggaggaagtagaaaatactatttggaataaaaagacacttaaacattgaatatattcaaatggtttcttctcaggaaggtgaaatgacttcaagtcctgtgtgctaacaaggtcattctttgaagctttgaaagtgaagtggtaattcaattttcttacttttctggactgttgcatatcttacaaatctattttcctcacctattttttcccatcttaacaggataagttagtttcttcacatgtgaagaggtaataacatttctttctggaaaactaaggtttttattttattttttaatcttagtgtgacattcatcccttcagttatatatttaatgtcccatatatctctcaatagaatgaggctgtggttgttacaagagtgaaaaggacagagttgaaatgccaaaaagcaaaggtcagtgatatgttggccaagacacaaaataatttaatatgatttttcccagatgagggagaatggtgaaatgtgtgcaaacatcaatttgctttggtcaagccattttatagcaattcaccctgttagagactcttgaaggtattgttagttttaggcctccactgtttgccaaatacttaggtactttgttttacatctattgcttagcatgttctctcagatcaatatagcaaagggacttagagcaatgaaaagtgaatagcactatcttggaaatcctatgcaataaagggctgggattgacatagatttaaaagacttatttagttatcctagggggtcccttatagaaacaattgcatttctttccacaataccacatttccatttataaatttcatagagtttttaaaaagttaatatgtgtaaattttgttatatacttgtatgttcatcaccacactattcacaatagcaaagacatagaatccacctagatgtccatcaaaggtagactggataaagaaaatgtggtacataaccatcatggaacactacacagccataaaaatgaattaaataatttcctttgcagcaacatggatggagttggaggccataatcctaagacaattaatgcaggaacagaaaatcgaatacagcatgttctcacttaaaaatgggagctaaatattgagcacacgtggacataaatttgcagtgtctattgcacatgggaacaacagacactgcaaactactagaaggtggaggaacagagggatcatgggtggaaaaactacccattgggtattaggctcaacctgggtgcaatatacccatggaacaaacctgcacatgtaccccctgtatctaaaataaaagttgaaaaataagttaatgtgtgcattttgaatgcttaaagttcttttccctgtcccctaccacagtaatattttaaataagaggggcaaaatgaaagatgtatgagtgccccaaagcaacccaaatatttatcaagaacttacagaaatttaattgtttctgatatgggcttatccttatatttcattactcagtccttcttttatccaaatttttagccactatgagatcttcctggacccgaaagactaaattacctctttcatattatctttctctttatataactccaaaaacgtttcttcttccctaaagatgtggctttgttgttgtgttttctgactatttacatacttggtttggtatagatgctgtcaattttcttcatagccaaaaggaagataaaagaaaaagaaaagccttctacaaatcataatttatttataaccaagaaaacttaaactggggacaagtcttgttcacgtatgtcaaaaatgtatattgttacaagcataagtaaatttacattgtcagaagagtttcagtgtaagagagaataaatatttacatttgttagcttttcttggggtaaaacatggacccgttaaaaaaaattgttacaaagaagtgttaagggtattgtcaatttgtacatattaattgcattgctcaaaaatcaacaggaaattctctcatgttcatttaaagaagttatcataagtgataccactgtttagcaaagcaacttgaggtagtggaagaaacactgcattggaagtcaagtgatctaggaacatctttgccagttttttgttgttttttagaaagcttaatcatggaactaagcattgaatgagatcatgaagatgccagatttgttactgggattcaaaacatatttcagactctattttttttctagcttatttttcaaatgtgtaatagctatcagatacacgtaatcattagaaaaatatacacattgcatgatgtaaatttatcttctgcaacttctaatacagtattatgactttatttttactcattttgcacaggaattttttgttctcaaattcagccctattctatgattctgtttatatgttaggacatccatactcaaatgtgtgtagtgataggtaacagagatgcaaatagagaaaaaatgaaatatgcagtagtttcctacaatatattatggtttcttctaatttataattatattactattttctgctaatgtaattcctctagtttcttccaaagtattttctgaaactgtacttcaacaattattattttatatttttcatatgatgctcatcaaattctgacagtggttttgtttataatggattttattttgccagcatcattgtttaatgattgtattttggtaacaaatagtgaagagtatagcagagccagaatcacaaatcatgcctaagtattaagtaacagtggccctataataaaagttgatgagaactaataaattaaagataataataggaataattaaagataatattattaaacataataccagccagcaaaataaaaatttagtacctcttccttcatcaccaaacacacacgtgcacacacatacacacacacacacacacacacacacacacaccatttccaggcatatagacacagtaagattcctttataatatcaatagaattcctttataatatcaatacaattatggtatgagtttaccgttactttcctttataatatcactaagattatggtatgagtttactgttactcatacccagactttcttttttgattttggaaagaaaaaaagagacagaagaaaggtttccctctttgggatgataattctaagcgtaacatatggaataggtacaaaaggaaaaccaaaggaaatagctgtttaacttagattcaagcctttttttctcattagtccccagtttacatgatcctctacgacacgaataggtctttctaaaatacttgttccgggtgtcttctgtaccgctgggatgctccattaggctataccaaatgacgctggattatcacccagaattcccacttactaatattgatcagttcatttgtagtcctctcttgatatagcttctaacgaggcgtaagtccatattaattcattatattcacttaacaaatatttttgagcaccaagaatgtgcccagctaccggtatggtaggtgctggtgacaaaacagtgagcaaaacaaaggctgcagccacctgaaacttacgttgtactgacacttataatagggataaagtagagtccaagtaactttcagctctttcttggcatatggaaggagcagcataatcatcacagccccagataccctctccactctagtcttgcaggaagaagctaacaatcatagaaactagtgcctgagtttacagttctagccactactcttgtccccaattccttcctggtggtaggttaagggagagaacatactgtctcattatagatccatggatagttcttatatctttcaaattagtcaattttctgccattgaaaaaattctcattgcctgatgttttcagtcagcccattgccacttttctaatattgtatgtattttgtccatacttctgggattcatttggttagaaaaccctcaccaatataggaaatcattccatgaagttgcaggaacatcatgatgtcttaaaaatacttctgagcactttttaaatctctcatatacttaatgaaactgtaataggcaatccccagttcccatcctgtctccgaattcagtagagaacttaaagtcaaaacaagtcatagaataattaatttactactcataaggacagatgttcctcatggctgactctaactgtgtatatttaaaataatcaggggtcattaaaagggttccactagccttctccaaatagagacctctgtcattctctatcatgaagtcaatgtttctgaacactataattattttcatatttttgttcttcttgaacacggaaacacaaagaacaattctaagttttaaaagtacctttcgattcaaaccataaattccctagacttttattttagcttgtaaaatgaaagacgatgatctcacaaatctgaatctgatcagtttataagtttctttcactttaccctgattcaggctcctgttggccttaatctttattttaaacaccatacttccagattttacttagaaactaaaattaaaaattagatttttaataaattggacatttttcaaagatgtgaacttaagaaatattggcaccactgaaccttccataaacaatggaacatacattcattcaattaacataatatagacgatgatattatttactcagaaggattgcttacacataattattcaacgtgagaataaatggtaacatacaattactaaggatacttgcacgtaaactcaacgtaaaaacagtggtgtgcctatttgtaacagtttattataagtatattaaagtttatggtaattgtgaataccacactggcattcacaataataacagtttacgttctacattcccatacagctacactgagcagctaaacttagctataatcattagtatatttgtaattgacttgcaagttacaggcacatttttcctggcagaaaatgcacctttcagatctaattttaagaatcagtactaccaaatatgggatttattcaaagataccaggaagattctttgtgtctaaaacacgcacctccatccttcagaggcctggatttccaaaattatgccctatcttctcataagctaaatcatgattttgtctcctacaaaatatcaaacatcttttgaagaaaacgtattaaacccaattggtcaataataacattgtggttaagttttaaattattttgtgtgtgatagtttgactgttactaaagaaagacaacatcaaaaaatgcatctctcttgtcccttgtacatattaagtgcttaataaatgtttgcctaatgaattcagtaaattgtttattacccgcctgctccgtgcctgacatcatactaagaagcaagaaaacaaagtaatctaaaggataatcctcgacattaaactctagaggcagacacatgtacaaataagtggattattctagcaatacacacactattctactgaaaaaaacattcttttgggatggatgtcagaagaaatggtaattgatttggacataggagcatcactggacagctttatgaagactcaatttacagttaaaataaagacaataattctaatgcttattctggctaatttttagatctaaaacttatgctggaggaaacagtgataacaatgattcatctcaactctgttggtttttttttaatcatcagattcaactttgtaaagaaagcccacctacttctaattagcagatttatacatttttaaaatctttaaaactttggtaaaatacacgtaacaccaaatttacgatcttaatcatttttaggtgcacagttcagtggtgttaagtacatttacattgttgtacaaccaatctccagaattctttttgtcttgcaaaactaaaacttaattcattaaaaaacaactccccactctcctacttatcccagcccctggcagccaccattctaatttctgtctttatgaatttgactactctaggtacctcacatagaatactgacatttttcacttagcctaatgtccctcgcagatcacgcatgttgtagcatttgtctgaatttccttcccttttaaggtatacaccacattttaaggtatatacaccattttttatttgtacatttattcactgaggaacatttgggttgtttctaccttttggctcctgtgaataatgctgcagtgaacgtgagtatacaaagatctctttgcgaccctattttcaggtttttaaaagtacacatccaaaagtgaaattgctggattaaagtaattccattttcagtttcttggggaattgccataatattttccatagccacaccattttatatttctacaatgtaacagtacaaaggttccaatttcttcacatattcacagatattttctgtttgtttgtgagtagccatgctaatgggagtgagttgctatctcgtggtggtcttaatttgcatttaactaatgaaagtgatgttgagcatcttttcacgtgtggttgaacattttcatgtcttttggaaaaatgtctactgaagttctttgcccatttttaaattgggttatgtgttctttcttgtcaagttgttggagacctttcatatcctagatattaggcccttatcagatatatgatttgcaaatatttttctcatttcatgggttgccttttcactctgttgattgtgtcctttgatacataaaagtttttcacttttatgtggtccaatttatctatttttttttttttttttgagaccaagtcttgctttgttgcccaggctggagtgcagtggcacgattatcgtaaactgcagcctcactcctgggctcaagtgatcctcctgcgtcagttttccaaagagctggggctaaacgcatgcatcactgtgcgtggttaatttttgtattttttgtaaagaaacaggttcttgctatgttgcccaggctgctcttgaactcgtggcctcaagtgatcctcccacttcagcttcgcaaagtgctgggattataggcatgagacaccgcacctggccgctattttctcatctgttgcctgtacttttggtgtcatatccaagaaataattgccaaaccaaaactttccctctatgtttttttctaagagctttatcgttttagctcttacatttaggtctttcatccattttgagttaatttttgtaaggtaaatatccaattttattcttttgcatgtgggtatccagttttcccaacaccatatgttgaaaagactctcttttccccactgaattttcttggtacccttgtcaaaaatcatttgattatatatgcaaagacttatttgggggccttctattttattctactggtctaaatgtctagtagaccttagtagccagtaccgcaatttttattattatggctctgtgagaatcatatacaattttgcttggaattatgttcctggtagagttgacataggagctcaggtattctgtctactctaatggttacagtcaggttctttgcatctaatggaaggaatcactatctatttgaatggaatctattttggcttcatatgaattacaatttttctctgattgcaacttaatactaacagattatctgatcccatttttgttttatttttggattctaagtaggttaatcattgttactcttggtagtgagtttgtcttaaaaatgaatactaccttcattacttaaattacagcagttgtgacctcctacaagtaattatttttacatttggtcaaatcccaaaactaaagtcttatttggatttttgctgaggtatttttataaacattaaatatttttgagcaggtttatttcagtttaaattatttcaaagtaaacaaattggtatcaaaatgcagcccatattaaatctcaattattgaaagccatattggcaaaacaaattagttcaaaatatagaaaagctcttctttggaacatcgaacagttttgtgctgtttgccaatcttgcttttctggatgaattatcacagattgatgtcagaattcaaagtcatttttaaaaattcaaaaattttagaatttttaaattatagaatattctacctcttatatggaccttgaacactttccaattaaggctggatataatcctagtttgagaccagtctggccaaaatggtgaaactccatctctacaaaaaataccaaaattagctgggcctggtggcatgtgcctgtagtcccagctactcgggaggctgagggaggataattgcttgagcctgggaggcagaggttgcagtgagctgagattgcaccactgcactccagcctgggcaacagagtgagactttgtctcaaaaaaaaaaaaaaaaaaaaaaaagactggatataatcctacgtttgaaataccagatatatctatgtataatatctgtatgtattcactcccaaattgaattgtttcgtttaaaaaataaaaatatatgtcgtggaattcaaaataatgtatttaatattcatgtcatgggtaaactggaataaagaaaagaaagagggaagggctgaaaagctactcaaagaaacaattggctaaaacttctcaaatttggcaagagacacaaccctgtagattaaatattccaagaaaatccaaaacaggataaactcaaagaaaatgacatcaagatacataataattaaactttggagcactaaagagaaggaaaaaatttttgaaagcagctttagagaaacaattccttacctgtaagggaaaaacactgtatggcaacagatctctcatcagaaatcatataggccagaaggaaatggcacaaagtttttcaagtgctgaaagaaaagtactgttaatgcagagtcctatagttgaaaatatccttcaggagtgaaggagaaatcaaaatattttcagatggagaaaaactaaaagaatttgcaacaagcagaactacccaaaaacaatgtaaacagggagttttctaaacagaaaaaaaatgacaaaaaaggaaccatggaatgtaaggaagggggaaagaacatggtaggcaaaaatatgggtaaatacaatagcctttccatctcctcttgagtttttaaaattatattttatggttgaagcaaaaattataacatcctatgatgtggttctaaatgtatgtagaggcaatatataaaataactattataaatggggtgagtaaaaggatttaaagagagatgtaaagtttctatacttaaactgataaaatgatgacaacagtaaactgttatgagaatacacatgtgtatacatatatacacacacacatacatatatgtgtatctcaaccaataaaaggttataaaaatatatagagagaatactacactccagataaatcaaaatggatttctaaaaatagtccaagtcacccacaggaaagcaggaaaaataaaagagagagagaagcacaaatcaaagagaaaaaagagaaagcaaaaaataaaatagcagacttagccccagcacataataattatattaagtgtaaatgatctaaatgcaccaaattaaagatagggagcagcagagtgcattaaaatatgacccacctatatactgtttacaagacacttacttcaaatacactataatgacaaaggcaggttgaaaataaaaggatggaaaacgatataccatgaagacaataataaaagaaggagtaactatattaatatcagataatatagatgttagagcaaagaaagttaccagtgacagacaggcacattatataatgttaaaagggtcaatccactaaggcacagcaatcctacgtgtgtatgaaccaaataaatgagctgcaaattatgtgaagaaaaatctgacaaaactgaaaggagaaataaagaaatcacaataacagttggcgcctttaacacccttctctcaataattgataaaacaagtagacagagaatcaacaagaatacagaaaacctcagatacaccatcaaccaacaagatgtaattgacatttatggaacacttcacccctacgacagcatcatacacatttttttcagtgcccacagaacacatactaggatatatcatgtcccaagccatgaaaacaacctcaacaaattcaaaagaattgaaatcatacagaacgtgttctccaacaatgaatgaaactggaaatcaataacagagaaatagcaagaaaatccccaaacacctggaaacaaaggacataataaatgtatcaacaaggaagtctcaagagaaataaaaatacattaaatagaatgaaaacaaaaatacaaaatatcaaaacttgtgagacgcagctgaagcagtactaacaaggaaagggatagcgctaaatacacacattagaaaagaggaaaagctggataactcatacattgatgatgggaatgtgtaacgctatagccactctgaagacgggttagaattttctacacttgatcttacccaaaaggctgagaagcgatcagtttagaatgttcttaaagaactaaacatgcaactgtcatatgatctagcaactgcattcctgagcatttatctcaaggagattaagacttgtgttcatgcaaaaatatatacacaaaggaagactactcagccttcaaaaagaagaaaatcctgtcaatgtgtcaacatagatgaacatggaggacattatgttaagcgaaataagccaggcacagaaaggcaaatgccacatgatctcacttatatgtggaatctgaaaaaattgaactcatagaagcagagagtagtatgacgtttatcaggggctagtaaggaacaaaggaaatggggaagatgttggtcaaaggacacaaaattctagttagacgtgaggaacaggcccaagacaactactgcacaaaatgatggctatggttaataatgatgtactgtataacctgaaaattgctaagagattagattttaagttttctcaccacaaaacaatggtgaggtaatgcatatgttaactagcttgattttgccattgtacaatgtaaacatatttcaagatatcatactgtacaccataagttcataccatttttatttgtcaatgaaacataaatgaataaataaataaaaagttacttagaccagaaagcaaaaccaaaaacaaagctgcatacacaaatgcttatagcagcttcactgctttatttgtaatagacaagaactggaaacaacacggatgtttttgaataagtgaatgctgaataaactgtggtacatccataccatggaatactgttcagcaataaaaagaaacaaattattgatccatggaggaacctgcctgattttccacaggtctccagtaatttttctatgtgaagaaaggcaatccaaaaaggttatatactgtacatttctatatttctgaaagtataaattatggaaatggagaacagatttgtgattggcagggcttaagaaggtattgaggagggtggaaggaaagtggttatggctaaaaaaaagggggcaacaggatagttcttagtggcgatgaaaataaatgttctgtgtctcgactgtctcaatatgctggttgtcatgctgtgttgtggttttgaaagatgttaccattgaaggaaattgagtaaatgatacaaagaatatctctgtactacttcttatatttacatattgatctacaatattcttaaaatagtttaattaaaacaaacaaaaaaacaatgtaaataaatcagagtgaccttttaaaacatgaacaaaatgtattatttgttgtgaagcttatagtctgacttgatctcctgggcaaccagtgtaaaaaaaagagaaatataatccactctataatttgctttatcagaatgaaggaaatatattaaagagcttatctgaaaatgcaaggaatttcttagaactaaattttaaaataattatttagatttttacattgaatcccacctactacatcaaaatattagatcatgtactcatacacagagatgatgagttaagcctgagatgagctgtggatacttttgccaattcatggggtgagttgagggaaacagagctaaaaggagagaggaagattttgaaaacactgatccagcagtgctggaaattcatccctgtacttttaagctaagtaaactaaccacagcccccctcccagcttttcttttctctttttcttttcttttcttttttcttttcttttttttgttttcttttttttttttgagacagagtctcgctctgtcacccaggctgtagcgcagtggtgcgatcttggctcactgcagcctctccctcccgggttcaagtgattctctcccctcagcctcccgagtagctgggattacaggcacctgccatcatgctcagctaatttttgtatttttagtagagacagggtttcaccgtgttggccaggctggtctcgaactcctgacctcaggtgatccacccgcctgggcctcccaaagtgctgggattacaggtgtgaaccactgcgcccggctgctttctgtcttattatttttgaatcactttctcacacttaacaactaaactcattgtgatatgtatggaatttcctgtctcataaggatttagattaattaagacatgtaaagacttagaatgatatccgatgtagggtaaacacacagtaaatatttgctattataatcacaaggttgctatgaggattaaattggatttttgtcattctttcctttattcaaatatttatttagcacctactatgtgccaggaaccgttttagttcctggtaacagaacagggaacaaaaaagacaaaaacccctgccctcaaaaagctcaccttttgcgtgaatgcccctcttacctcattactatttaataactcctccttcaatacatgtaaattagtatttaaatgagtataaattgcaatttcccactttgagttgcaagagatgaggctgcctagtgcaaatcagcattccactcatactcatatatttccgccacctgctaaaccaatattcgtagcattttccaaatactaacatgcttcaatttctctggataccctccaccccaaaacccactataccaagcttgatcctcaaaatatatccagcttgattcatcattcagctttattatatggctattactcgttagttatattagggctaattatcttaccttgggagaaataattaagcttgtataaacctcaaatgaaacattctgaaacttacattgatataaatcatattcccaataatgttgaaaaattaaatgaaatgaataaattgtctagaaattataattgccaaaatcacccaaaatagaatgaataagaccttctatccgatagcacaacagggtgactatagtcaacagtaacttaattgtatattttaacataacttaaagaatgtaattggattgtttgtaacacaaaggataaatgcttgaggggatagaaaaaataaattaaggaaacaaacgtgacccagaaaatgtacaaacaccagtaatattttaaaaactaaattacatggaaaaaaacaacagcaatttctacttcttaaaagataataaagccggatgattttgcaggcaaatctttactaaatatccaggaaatgtataagacctatcttatacaaaatgtttcaaagaaaaaaggagagaaagttaattaatatttgatgcagttaatataagcttgatataaatattgagcaaaaatatattaatcaataaataacaacaagaacagtaagagaaaaaaattaccaacatacacacaaaaatcttgtatatattttggtaccagcaaagagaattaagcagtgggaaaaaaatgtctgactaggtataacaagaaagtgaaaacttctatttacctgaaaagataaacatgatgattatgacttgcagtccctgcaggggtccctgttatcaaatacactgaaggaagaatttccactcctgccgaccaatggtctctctccgggcactgctgctcacaggaggttctccaggcacctctgggctaagtgtgcttaacttcttgaggtgccggagcatcgcaattatttgagatttcttctacaaatggacagaattacccacttgtcactatgtgttacactgtcttctgggcatgaaatgtgtgggattttactatcctagggttttatagtcaccagtctatttggcaataaccctttagaagtaaactatcaaattcaaaaatggctgcccacccccgccacagctttgcaatttgattaaccccttctcccatccctccatctctcctaacattagatttgataatttttccagcctgagtaaatccctccaatgctagcagcttattctccctaatcaaaacctcccattcaaactctgatttcttaccatcaactcctgatcaacaccatgctcattgtcctgcttcaattcaacctcctagcaatatcacattttcacactgcatccacacacagtgtaaaaatgtccacaatgctaaaattcttcttaaaaaaaaaaatcgcacaagaaaggaacccaggaggcactgttgaaggtttcatttgcttgtttgtttgtttgaggcctggtgtttaaaaatcttctgggccaggtctgagcgtccaattttttaacagctttatggaggtataattggaaaacaaaaaaaaaccctgcatatattcaatgtctataatttgatgagtttgaaagctgtttttccttgaaaaagctattcttcacatttttgaaattttgaaatcaatgaatttttaaagtagcctttctaaccaaatactgcacgttctcacttataaatacaaggtacacattgggtacaagacagcctacagaatgagagaaaatatttgcaaactatgcatctgacaaaggcctaatgtccagaatgtatagggaacttaagcaattcagcaagcagaaaatgaataactccattttaaaaatgggcaaaaaacatgaacagacgcttctaagaagacatacaagtggccaacaaacatgaaaaaatgctcaacatcactaaccatcagacaaatgcaaaccaataccacaataagataccatctcacaccattcagaagggccattattaaaaagtcaaaaacaaaaacaaacaaacaaacaaaaacagatgtcggcaaggctgtggggaaaatgaaacacttatacgccgatggtaggaatgtatattagtccagtcactgtggaaagcaatctggaaatttctcaaagaacttaaaacagagctaccatttgacccagccatcccattactgggtatatacccacaagaaaataaaccattcgaccaaaaacacacatccacttatatgttcatcactgagcaattcacaatagcaaagacatggaatcaacccagatgcccatcaatggaaaactggacaaggaaaatgtggtacgtatacaccatggagcattatgcagccataaaaaataatgaaatcatgtcatttgcagcaacatagatggagctggaggccatatcctaagcaaattaattcaggaacagaaatccaaatatcgtatgctgccacttataagtgggagctaagcactgagtacacatggacacaaagaggggaacaatagacactgtggactactagagggtggaggaggggggttggttaaaaaaactacctatcaggtgctatgctcactaccagagtgacaagatccatactccaaacttcagcatcatgcaatagtcccacataacaaatcttcatatgtgtccccaatatctttttttttttttttgagacagagttttgctcttgttgcgcaggctggagtgcaatggtgcgatctgggttcaccacaacctctgcctcccatgttcaagcgattctcctgcctcagcctcccgagtagctgggattacaggcatgtgccaccacgcctggctaattttccagtagagacggagtttctccatgtgggtcaggttggtctcaaattctcgacctcaggtgatctgcctgcctcagcctcccaaagtgctgggattacaggcgtgagccactgtgcccagcctgtgtccaatgtctaaactaaaagttgaaattaaaaatcaataaacatacagagggtacacatggacataaagatgggaataacagatgggactaccaagaggtggagggatggggtaagggttgaaaaactacctattgggtactctgctcactacctgggtgacaggtttaactgcaccccaaacctcagtgtcacacaatatacacatgtaacaaacccatacattagcccctggatctaaaataaaagttgaaattgaaaataaaaaattagagtagcctttctaaagcctccaattttaacgttaaaaccctcttaaagaggaaatataatggtctacagttcatgtcttttcaaccccatgccagttatagcagacactgatactttgttctctccatctgtttttattctattactttttctcagtcttgttcagttatctaccctcctccactgggccatgtgttttagacactatatttgatcttagccaaaatactgagaagtgttggctatgtgtttcagaaacttgcccttagagatgaatctacggtggtgatatcatttttgtttgttttggacatggatttgttacataattttagtcaatgaaatggtgagaggaagtcttctcagtggggaaggaggatgaaactttgggggaggtatttacttgctttttaaaaaagaagaccgaagaagatcaaggaatgtttttccagacattgttgagtttggatgtgattcttgaaactgaggctgccatctcactgttatgagggaaattagcctgaagagcttgaaacaggaaggatggcaaacagaaattagaaaaatccaaattcttaaaagggtcactgagcctctgatttaatcagccatagagttgtcccatctcttgtctttctggttagtgaaataaaaatctttccctactgtttaactctatttgaatttacttttatactacttcctatcaaaggtagtcaaattgataaagcaatttcagaaaggaaatattctgcctttctctctacatctatgcttgcagattaccgagtgaatggtatatgtttaatttccatacaagaattttgatgtaaaacatgtatttgagttttcatttaagtgcttttattttgcttcaacagtaggagaaagaacaagaacttgagatccataaagaaaggcatgattaataacccagcctgatgttgggctatctccacaaggcaggccagggaaattccctctggagagttcaggttttatcaattcctttttcagtaactcactatcaaagacagaattcttgattaaaaaataaaaatggattctacctttaacaagatcagaggcactaaataaaaatgatgccaggaacatccaaagcaaatgaacaccatttagatatatggttcaccagaaaaatacaaataaagaagagttcagcatgtttattcctaagttttaaaagttataatggaaaataaaaccattaaagtaagatcaaatttggagcctgcagaacaccatctttttttcatcttggcttacaacactaaataaaaaatgacaattactttggcctgtggttatctcaaagacagccaagtaatgtttgagtggatgtaagcttgtatatcctcatgaatataaatccaagatttagagatgctgtactgtctcgtgcatttgtctcctcttaagctggtagtccatttaatttaataaactcatacctagtatctactgcaatcaaatctaggtactaaactcttgaggggcagagaggaggatgggaatgaggaaaagacaaatgaggcaattgatgggttaaaaaaaaaagccacatcaaagtcgtctgcaaaactaattataatgttagtttctgatgctcttccatgctgtatctaaacaaaacaccaaagggcaaagagaaatgagaggattattttcagtcagggaaagagaaaaaaactcaaagaaaagatatcacttgaacttgggaaatatatgtagggttgcaacaagtaaaaactggggtgaggttttcttgtccaaggaaacagctcaaaggttacacttggggaaaatattctaactttcacatagcctgtagcagtggatctcaatcttggctgcatattcagatcaccaaggaaactttttaacacctaatgcctaatctacaccttgaaccacaatttctgggaaggaaaccaggtgtccggattttataaaattctaagtgattccaacctgcagtcaagatcaagattctctggactgtaaggacctccctgctctagtctctatcctctcctctacacttatcacccagcactcctattgtcaccgctatacaaacagatgggcattttttctgttccagaataagcttttctttcccttcctcagagcttcatatacgctgctccctctgcaagaatgtttttcctcccaaactctccttcactggctaattctgctagtcttttgggactcaggttttaattcttctgaaagcattattaacagttgaatcaaaattagattctgctgttaaatgcccatcataccccatttagttccttctgagtacttaccacaatttacaaatataaatgtatctgtgcaattgttggttcaaggcttttttgcctctattaggttggtgtaaaagtaattgcagtttatgccattaaaagtaatgtaatataacaaccatgagagtggggagtatagagtttcattcactcttttatcccctatttctaaaaccatgtctaggggtagtaggtgttgaattaaaacttgtggtgaagatactcctcgagaagagcaactccaagacacataattgtcagattcaccaaagttgaaatgaaggaaaaaatgttaagggcagccagagagaaaggtctggttacccacaaagggaagcccatcagactaacagcggatctctcggcagaaattctacaagccagaagagagtaggggccaatattcaacattcttaaagaaaagaattttcaacccagaatttcatatccagccaaactaagcttcataagtgaagaagaaataaaatcctttacagacaagcaaatgctgagagattttgtcaccaccaggcctgccctaaaagagctcctgaaggaagcactaaacatggaaaggaacaaccagtaccagccactgcaaaatcatgccaaattgtaaagaacatcgacgctaggaagaacccgcatcaactaatgagcaaaataaccagctaacatcataatgacaggatcaaattcacacataacaatattaaccttaaatgtaaacggactaaatgctccagttaaaagacacagactggcaaattggataaagagtcaagacctatcagtgtgctgtattcaggaaacccatctcacgtgcagagacacacataggctcaaaataaagggatggaggaagatctaccaagcaaatggaaaacaaaaaaaggcagggattgcaatcctagtctctgataaaacagactttaaaccaacaaagatcaaaagagacaaagaaggccattacataatggtaaagggatcaattcaacaggaagagctaactatcctaaatatatacgcacccaatacaggagcacccacattcaaaaagcaagttcttagagacctacaaagagactaagactgccacacaataataatgggagactttaacaccccactgtcaacattagacagatccacgagacagaaagttaacaaggatatccaggaattgaactcagctctgcaccaaacagacctaatagacgtctacagaactctccaccccaaatcaacagaatatacattcttttcagcaccacaccacaccgattccaaaattgaccacatagttggaattaaagcactcctcagcaagtggaaaagaacagaaattataacaaactgtttctcagatcacagtgcaatcaaactagaactcaggattacgaaactcactcaaaactgctcacctacatggaaactgaacaacctgctcctgaatgactactgggtacataacgaaatgaaggcagaaataaagatgttctttgaaaccaacgagaacaaagacacaacattccagaatctctgggacacattcaaagcagtatgtagagggaaatttatagcactaaatgcacataagagaaagcaggcaagatctaaaattgacaccctaatatcacaattaaaagaactagagaagcaagagcaaacacattcaaaaactagcagaaggcaagacataactaagatcagagcagaactgaaggaaatagagacacaaaaaacccttcaaaaaattagtgaatccaggagctggttttctgaaaggatcaacaaaattaatagaccactagcaagactaaaaaagaagaaaagagagacaaatcaaatagacggaataaaaaatgataaacggcatatcaccaccgatcccacagaaatacaaactaccatcagagaatactataaacacctctacagaaataaactagaaaatctagaagaaatggataaattcctcgacacatacaccctcccaagactaaaccaggaagaatttgaatctctgaatagaccaataacaggctctgaaattgaggcaataattaatagcttaccaaccaaaaaaagtccaggaccagatggattcacagccgaattctaccagaggtacaaggaggagccggtaccattccttctgaaactattccaatcaatagaaaaagagggaatcctccctaactcattctatgaggccagcatcatcctgataccaaagcctggcagagacacaacaaaaaaagagaattttagaccaatatccctgatgaacatcgatgcaaaaatcctcaataaaatactggcaaaccgaatccagcagcacatcaaaaagcttatccacaatgatcaagtgggcttcctgggatgcaaggctggttcaacatagacaaatcaataaatgtaatccatcacacaaacagaaccaaagacaaaaaccacataattatctcaatagatgcagaaaaggcctttcacaaaattcaacagcccttcatgctaaaaactctcaataaattaggaattgatgggacatatctcaaaataataagagctgtttatgacaaacccacagccaatatcatactgaatgggcaaaaactgaaagcattccctttgaaaactggcacaagacagggatgccctctctcaccgctcctattcaacatagtgttggaagttctggccagggcagttaggcaggagaaggaaataaagggtattcaattaggaaaataggaagtcaaattgtccctgtttgcagatgacatgattgtatatctagaaaaccccatcgtctcagcccaaattctccttaagctgataagcaacttcagcaaagtctcaggatacaaaatcaatgtgcaaaaatcacaagcattcttatacaccaataacagacaaacagagagccaaatcatgagtgaactcccattcacaatcgctacaaagagagtacaatacctaggaatccaacttacaagggatgtgaaggacctcttcaaggagaacttcaaaccactgctcaaggaaataaaagaggatataaacaaatggaaggacattccacgctcatgggtaggaagaatcaatagcctgaaaatggccatactgcccaagataatttatagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacgctacctgacttcaaactacagtacaaggctacagtaaccaaaacagcatggtactggtaccaaaacagagatatagaccaatggaacagaacagagccctcagaaataatgccacatatctacaaccatctgatcgttgataaacctgacaaaaacaagcaatggggaaaggattccctatttaataaatggtgctgggaaaactggctagccatatgtagaaagctgaaactggatcccttccttacaccatatataaaaattaattcaagatggattgaagacttaaatgttagacctaaaaccatacaaaccctagaagaaaacctaggcaataccattcaggacataggcatgggcaaagacttcatgactaaaacaccaaaagcaatggcaacaaaagccaaaattgacaaatgtgatctaattaaactaaagagcttctgcacagcaaaataaactattatcagagtgcacaggcaacctacagaatgggaaaaaatttttgcaatctatccatctgacaaagggctaatatccagaatctacaaggaacttaaacaaatttacaagaaaaaaaacaaccccatcaaaaagtgggcaaaggatatgaacagacacttctcaaaagaagacatttatgcagccaacaaacatatgaaaaaaagctcatcatcactggtcattagagaaatgcaaatcaaaaccacaatgagataccatctcacgccagttagaatgactattattaagaagtcaggaaacaacaggggccgggcatggtggctcacgcctgtaatcccagcactttgggaggccgagccgggcagatcatgaggtcaggcgatcaagaccatcctggctaacacggtgaaaccccgtctctactaaaaatacaaaaaattagctgggcatggtggtgggcgcctgtagtcccagctactcgggaggctgaggcaggagaatggcgtgaacctgggaagtggaggttgcagtgagctgagatcataacactgccctccagcctgggcaatagagcagagagactctgtctcaaaacaaacaaacaaacaaaaaaaagtcaggaaacaagagatgctggagaggatgtggagaaacaggaacacttttacactgttggtgggagtgtaaattagttcaaccattgtggaagacagtgtggcaattcctcaaggatctagaaacagaagtaccatttgacccagcaatcccattactgggtatatacccaaaggattataaatcacactactataaagacacatgcacacgtatgtttattgtggtactattcacaatagcaaagacttacatctaacccaaatgcccatcggtgatagactggataaagaaaatgtggcacatatacaccatggaatactacgcagccacaaaaaaggatgagttcatgtcctttgcagggacatggatgaaactggaaaccatcattctcagcaaactaacacaggaacagaaaaccaaacatcgcatgttctcacccataagcgggagctgaacaatgataacacatgcacacagggaggggaacatcacatactggggcctgttttggggtggggggaggggggaggagaaatacctaatgtagacgacgggttgatgggtgcagcaaaccaccatggtatgtgtatacctatgtaacaaacctgcacgttctgcacatgtaccccagaacttaaagtataataataatagaaaaagcctacgggaatagtatacaggatagattcaattagaggagtaggaagagggaaaaggttgttttgataaattgttgtcaataacctaagaaatggtaatgaggacataagcaaaaaacaaaaaaaaaaacaaaaaatgggggctggcatgcagaggggattcactgagagatgagctaagcaatgactaaaggtcagggctgaagaggagaaaattctttgatgagtaactgctgctttctgtgattggactgatgagggtggtgagatctggcggtattgcagaacacggcatgatactcatagctgcgaggcttggtgatttatctcagctctgaaaaattgaaagtgtcataccggtgatgttaaagagtgactcaggtacctgagcaaggctggactgagatttccttggtggcatttacttatctatctctttgcaatacataggattctgagaaagatacgcctactgagtgtgtgggcttttccctcctctatgttgctgatttacccaaggcaatttcccaatgccattttcacaacaactgaaactcatttgatcattttttttttggtacaaagaaatgaggattattttcatgactgatatatatattcaaagaaactactgaaaaatgtcctatctgagaaggttatttgaatacttttaaatgtcctgttcttatacactacaacttcaaggaagctgctgtgaatgtgtatgggggagagagagaggaagagagagagcagggagaatcctgatcacaacaactgattcaggttttctagctagtttgtctgctgttgctttccttccttaccaattggtttcctctcaaaattatgtttacttaagatagatttacctttccccataagaaaacattatcatttagttaaggacattgtatatgtgtgtgcatacatttgtgcatacatatgcatgtatgtacctctacaaagagaaataaagaagatatgtcccatatgagtttataaggtatagtagataacattaatagccccaattctttattcctctctgattccaggcagacaattttccatgtaactttttagtttttccagctaaagaggtgaagttgatttccctactcctggttttggagttagataatgtgacattttttggccaatggaatgacagcggaagtcatgtgtctaaaatgctagacatgcttgtatatgatcaggtttattctcttgcacttctgccgttactataaaaaaaaaaaaaaaaaaaaaaaaaaaaaaaaaaaaaaaaaaaaaagctcctgccgatctcaggaggggaatgaaagatataaggaacagagctgccccagccaaatcatgacagtcaagcttagtttagctcagccaacttacggcctactctcagacatgcgagaatgtgagaaacaaatatttatcggtatatgccaccaagatttttgtagttggttgttacaaagcatatcgttttaatagttgactactcaagaaaactacatatggtggttttaagagtgacttaataatttataacaaacaaatgtaaatgactaactctagatgtttagaattcatatgaaagaaaagaataagcagcagtaatctggatttattttcatgtatcaactgcgtttcagagaaatgcaagtaacttccaaaatgtatttcttgacagcttagagcattacaaattcaatttatttagaggaaaaagttatagaaaaggtttcggtgaaggattttaattttaaatagaaaataggaattctcaataacgaaatgcctatggtggatttagaggcagttccctatacataacttatttgcttaccaggtgtgtgtctcttttctcttcccaacccctgttgctcctatcctggcctcttatttttctatacttcactcttcttgagtccatatataagacatggaaaccattgtctgagtcctagaaccggggagaagatgagtgcatcctcctactgtagttgttgttgatgcatttggaaatggaactcaaatttactttcccatatataaccataggttaataactagcatctatgtactatccggctatttgtgccttaagacagaaatccaggaagtataaaaataacatacgggcactcagattttttttctgatatggtaaaaaatggcactcatggtttttcaaaaacaaaggttgaaaaacgatatgctccatgaagatccagattacttgcactccaaggataaactgagagatgtccagagaggttcaacatgtgcctcagtcccaagtttacatgagtcttctctaccacagacaactgaagattaaacaaacttgaatgttataagattttatttgtgtgaggacagcttttaatctttacccgtaatctttgcagagacaatgccacagttattagattggttattgttgcaagctatgtaacatggatagcagaaaatgtgttatgttacagatccagaacatatttggcttctatttaaagacaagcatgatgtgaggatgttaattgaaatttttaaaaggacaaaatatccttttatgttacacattcttatttccctacacattctgctaaagatcaggcaagacatcaagttctgaaaattcatcaattccaattaaatttgcattagcaacatccacatttatcaaagtgaattcctctaaactacagctatcatcttctactctactgcctctcataaaattaagctgaatatcagtatgcagctgatatactctgtctactgtcaaaagtgcgtttcagtgaaaaccttaaaaactaagagaaatagacaaacacaattccattttgttggtccagacatgtccatctctgtataaacctctattctcagaatcaactgggctccaaaatatgggatataattcaaggctactgtaactaattaatccacatgcaaagtttaggggcttccaattctaagttggttcttgtcatattggtgaaaataattgctatattgctattgtttttttctcattgagaactctattgataggccaatataaaatcaaatcttcttatgcatgaggaaggataataacacatgttatcatgccagagaagaccacagcacatgaatttcctgagttcaaagccattttatgttcccaggaatggttcttgccaaaaagaaattctgatggtagttcctccatggaagtagtttgttaagtatttgtgatttttagcagcttctctaatttaagtggctttttccaccagtatctctggtgggtcacaatttctaaggcatgggaaggtcctagcatagaggattctcatatgctactcttgaaagtagctctattggctcctctatgaattgtggatattcccttgctttctagaatagttccatactcctgggtagctgagtcatctgataccggtactacttctggggaactgctctttgtagaacattcactgagatagcccatgtcgtcaccaagctgggctagccttataagggatacttcaaaatcccctactgtttcagagggagatcttggatgacatcatacaaaattaccacaacacttattgtgatcctcttcctctctttccttgctttgtgatgtggcacaagtccactatctcaatcttgggatggaaagaagactttgtatttcaaaacttgaactccccagtggttacaattatgttccttcactcaccagggtaaaaatacaaacttggataactggaaaacatggcttcctaattccctaagtgagccagatccatcgggtcctttatttaggcaccagtgtcctatagtcatcaaggtggagaggtaactaaagtgatcctgaggtatactgacaacttttgaaaacagactgagctgcacgttacctttcagatttgattgtgaaaactcgaaaggctgtggcattttttaatcttcaatttttgtgtaaatctttgcaatcccatacttaacatgaccatagaatgttaatctggttgctaaaacaataggtaaataggtaggggaatttatcatccaagagagaatagaagattatgtgtatagagtctagtacataaggcactgtgtattgataaataatttttaataataagtaaattctggagctgatcatgtgtaagaccaaaaaccatcataccacttgagttgctttatcactctgccctttcaggcatgtccctatcacccttaatgctgtcagttatcatatgaggcagggtaggtattgggaatagggttgaagtttagacttagttgtcaggatctgtggtatgaagttttcatattcttcagcgcactcaaaccaaagctacagaatttaggcagcttattatccaagggactctatgtcccaatttgggaataaattaaggagtcgaattatttacatctgcaaataataaaaatgtttcttctttgggggaaagagagagagagcgagagaaagagagagcgcacatgctctatataattgagtttcaaatcaactctaaaattaaaagcaaaaggtaatgggaatctcactatatattgaaagacatactgtgtttatggatagaaagattcaatattgtttagatctcaattaccccaaaattgatctatagatctatttttaaaaagtagtgaagcaggcagagaaatttacactccagacaagacttcatattccaggcaataatgttccaaaactcttggtttactttgatgtatataatcaaggtgattcagtagggcaatatgctcttacattcatactttaccaacaggcttcctagaatttttatttaaaatttaagatcctcatgtagtaaattacatcattggttccaatgcttcacccttcctggtatgcaaaccctttgccatgtgactttgcatttcctccccgataagtgcatgagtcagcagagcggagcccaagccaaccacaaatccccgagaataaatgattgttgttttaagcaaccgaattttggagtggtatgttatgcaacatcattgtgacaaaagctaacttactgatatatccccatgaagaacatttagacagcattgctcctgcttatattaaaattgtgcttgaacatgtgtgcctaacattgtgacatatgacatgttacatgaaataaaagacaaattcctgtccttgatgagctctcaatctaaaagtgtctttcctaatctaacaaatgctgttattgaggaggcagattttctctgctatgtcattgtgctggttcatgaatactgctgtctggttgttttaaatatttcagttagttatccactttactgtgcttctgccccgaggcttaaagctaacagcatagtttaaggagaaagaaaaaaaagacattaaaacatcactcttgctgaagcagtgatggagatcattgtaactatgtcaaggacattcctgtcagatattttgaattctaaccatacagccttaaggcagttggagcaaccctggggagggaagcaattgtcatacaatgttcatcagtgggcagcttcctttctgaacttttctctgccagtgtccagtgtccaaaagattagtcattttttgaaaagcttttcttgcttactatctctatgacttgcatgtatagtgttaatgagtttttaaatgtcccagaacattttttttctcaaaattcatgaggccaataaattggtgagtaataatagtctaggtaacattaatttattgatatatgatttatacaaaataaaagcagaaacctgaagtttgatgagttttgataattgcatgcacccacgcaaaaccaaaaacagaacatctatattatcccagaaagttctcttctgtccttttagaggcaatcatcccaaaggcaaccacttttcatttcaatcaatagaacttagttttgtctgttcttggacttcaatggagtctgtgctcctttgtgtctggcttcttttactcaacttaaatttttgtttctttgattttacatcaatccatgtcattgtgtttcagtaaactcattcctttcatattgctgagtttacatacttttataagaatacacttaatttgtttatccattctcctgtaaatagacacttaggttctttcacatcttgactgtcatgaaaaggttgatatgaatgttcttggacaagtcattctgtgcatataattttcattgtgtgtttgtgtttatgtgcagatatctagaagtcaaattttgattcagaatgttttactagataaatttagagaaattgacatttcaaccatatttattcttcaaatacatgaacattctattttgctccatttatttaggtgccctttcatttctctcagcaattgagagaaatgcatttccttcattatgtatattcttaggtatgttatttatgatcttgtggcattttaaaatataactttccaaatatttgtttatagcacatagaaatacaatggccttttgcatataatgagcttatatcttgttattttactaaattaacatactggttccattttttgaatattctacagtgttttatatatatatatatatatatatatatatataatcatgtcatctataaatagtgacagctttcttgcatttctaatcattaggtttttacatttctttttattgcctcatcattgaggctgagatctctaatacaacattaaatagtaatggtgaaagtagatatccataccttactctctatcctaggggaaaaatcattcaatcttttaccattaagtattatgttagctgtgggctttccatagatgatgcttaccagcttggagacatttctttctattcctagtttgcagacagttttgtttgttttgtttctttaaatcacaaatgtccattgaattttatcacattttttctctgcacgttttgtgtgcttatatgggttttctgctgtatttggcagtatggtggttatattgatttatttccaaatgttaattcaactttgtattcctgggatcagaacaatgaatgtgaccaggaataaagagggaaattaagtagtgacaaaggagcccatccatcaagaattatcaatcctaaatgtgtatgcacctaacaccagaactcccaaattacctaccaactctaattaagtgatgtctttaaaactctctaaccaacgatagaagaatacatattctatttgtgtatttgttgttagtatttcatatattttggcattttatttttctaccaaaaacagaaaaaatgtcagtccaatggtagattttgtccagtatctgttgactaatgaatagtttatgcaaccaacttgaaaattaaaaatatacctaaacagggtaaagatcacataaggcctctgagtattatttcccacaactccatgcatatctacaacaaattcaaaattaacagtttaatgaatacctttctatctgtaggagagagataaatatctaaataatattagatctattattattccatccagattttatatctttacgcttgtttgtattttttaaagttgttagtactgaattgaattacatagtattagattttactttaaagcaattttaatggcttttattccataattcaataagctttataatatgcctctattaatctttttttttctattatccatttccatagattcctaccaaaaacagctatcataaatgaagattttttggaaataggacaaaagatgtaaatgccaaggtaaataaacatgacaaatattacaaacttttaagtatttttttaaatttaaatagttttgctctgcagccaaaaagcattgatttataatggtacctctgaaatacattagaaaaactcatttgatttacaaggcttggttttggttttggttttggttctgggtttctgttttttttttttttttttcacttacagggctttttcacagccttagagatacatgattgcccagaaacaggcaaattatgcaaactttaacattatcaggaactgcacctaaagtttgtgttatgaacaactagtgtattagtctgttctcatgctgccataaagaactgcacaagactgggtaatttataaagtaaagaagtaaagaggtttaatcgactgacagttccacagggcttgggaggcctcaggaaacttacaatcatggtggaaagggaagcaaacgtatccttctttagatgatgacaggagagaaaactgagtgccagcaggggaaacgctagatgcttctaaaaccatcagatctcatgagaactcactcactatcatgagaacagaattggggaaccacccccatgatctaatcacctcccacaaggcccctcccccaacacacgggtattacaatttggattacaattcaagatgagatttgaatggggactaagagccagaccatatcacctaaaaaattataacttttgagaaaataatgcaccttgaagataatttcaaccaatctgtgacttcaggagtctgaggacattggttcagtatcttcattttcccttcttaattctttaactctgttcattttttcctctttttctctcatttccaatgttttcctacatctttccacaactgatcacatttattcaaacattgtatacttatatcaaaatatcatgttgtacaacttaaatatatacaataaaaataaaatttaaaaatcagaaattgaaaatataaatatgatttttaaaaatatttgggacatttaaaaaagtcacttctacacacttggagcaaagaaaaaatcatgatagaaaatattaaatatttagatgtggtcagtgattaaaatggaaaattaatattgtagagtatagtaagatgaatatcagagaaatatttataggcttaaatatcttgtctactgtattgaaataaagaaaatctgacaataaaaacacccttgaaataatttctttaaatgatagcaaaatgagccaaataacaaaagaagaaatgaaataaaaaatataaaaataaaactgataaaatagaacaatagcattcaatagtgaagattaataaaaacccaaggtagcactttgaaaagactaacagaaattttaaaaccttaggcttaactagtctagaaaaaaataatgctaagaattaaaaagtggtacaattacaaatacagtagagatttgaaaggtatattacaaaaacagataaaattgataattgattaaaatttactcagaaagaaaatataaataattgaaaatggactagtatccagaaaatgttaaaaactttatgatagggtgacatcactaatatggtggagtaggagacaccagtcttcatcacctcacaaaatacatgtatgtataagtacatacacacacacacacacacacacacacacacacacacgcacgctctctctctttctctctctctttctcatacacacacacactcaacaagatccacaaacaaaaaatagcccagagaggactcaagggctcattaaagaatctgcagcaacacagtgaaacaaagaaacagggaggacgtccaccacatacaaaggattgctggtgaaattggcatacacatttgggcacagtggctcaggcttgtaatcccagcactttgggaggccgaggcgggcaaatcacttgaggccaggagttcaagaccagcctggccaacatggcgaaaccccgtctctactaaaaatacaaaaattagttgggcgtggcgtgggcgcctgtattcccagctactcaggaggctgaggcaggagaatcgcttgaactgaggaggtggaggttgcagtgagccaagatcacacactgcactccagcctgggcaacagagtgagactttgtggaaaaaaaaggaaaaaacaaacaatggcatacccaagatgccaggagatggctaggagcaaaaacaaaggtggaggctattgatatcagtcacttggtgaaagccactatgatccccagaggcctgcactgcagagaacacctgcatctcttgctatttaggtaaccaatagccatacctgctgggaaacacacaaaagggagatacagttgcactttcctctcccaaaaagtggcctctgttgagcctctttgaaacagatggttatttgaaaatatatagtcagagaagaaaaaagaaacaaaagaatgaaaaggaatgaagaaagcttgtgggatttatggaacagcatgaaaagagcaaaggttcaagttataagagttcaaaaaggagaagagggagataaaagagtagagaacttatttttaaaaataatagcagaaaactttcaaaatctcgggaaagatatgcatttgcaggtaaaggaagagcaacggtctccattcagatttaatccaaagaagactacaccaagacattttataatcaagtgatcaaaaatcaaagacaaagagagaatcctaaaaaaggcaagagaaaagaagtaaatcacaaataagaagtaaatcacaataacgctggcagcagattactaatcagaaaccttacagaccatgagaaaatgggatgacatattcaacatgctgaaggcaaagaactgccaaccaagatgactatttggctaaactgttcttcataaatgaaggagagttaagactttcccagacaatcaaaagctaagaaagttcatcaccacaagacttgacctgtaagagatgctaaagggaattcttcaagctaaaagaaaaggacaataattagtaacatgaaaacatgaaattataaaactcactggtaaaagtaacaacatagtcaaatacagaatactctaatactgtaatggtggcatgtaaatcacttatgtttttagtatgaaggttaaaatacaaaactattaaaaatagtaatagctgcattaatttgtgaaagaatacacaatataaaagatgtaaattgttatatcaaaaacagaaaatgtgggggaggagaagtaaaagtgtagagttattttatgagatcaaaattagcttgttatcaccttaaaatagcctgttacaatataaagtgttttacgtaagtctcatggcaactacaaagcaaaaactatcgtacatatacaaaagataaaaagtgagaaataaaagcataatcatctaatcacaaagaaagacagcaagagaagaagaaacacaagatctacaaaacaaccagtaataattaagaaaatggcaatagtaagtttttacctatcaataattaccttgaatgtaaatagattaaatagtccaatcaaaagatatagagtggttcaaaagataaaaaaaaaaaaaaataagccccaactatatgctatctaaaagagactcattttactagcaggaacacacagagactgcaagtaaacatacaaaaaaagatatttcacacaaatggaaatcaaaagagagcaaaggtagctctactcacatctgataaaatagaccttaagtagaaagccataaagcaagacaaaggtcattatataatgataaagagatcaatttatcaagaatatataacaactgtaaatgtatatacaccaaacactggggcaactaaatatataaagcaataaataaaacaaatattggccgggcacggtggctcacggctgtaatcccagcactttgggaggccgaggcgggcggatcacgaggtcaggagattgagaccatcctggctaacacggtgaaaccccgtctctaccaaaaatacaaaaaatcagccgggtgtggtggtgggtgcctgtagtcccagctactcaggaggctgaggcaggagaatcgcatgaacccaggaggcagagctttcagtgagccgagatcgcagcactgcactccagcctgggcgacagggcaagactccgtctcaaaaaaaagacaaatattaatagatctgaagagagatacactaatataataacagtagagaacttcagcaccctacttttagcaatggacagattatctggaaataaaatcaacacaataacaatggacttgaattatactttggggacagatgaccctaacatcccatccaagagcagaagaatgtatatcttcatcaagtgtacacagaacatcccatccaagagcaggagaatacatatcttcatccagtgtacacagaacattcttcaggataattcatatgttaggctaaaaaacaagtcttaacaaatttaagaagattgagatcatatcaagtacctttcatgaccacagaagactgaatcatggaaaaatagaaaatataaacaaatgaataataagcagagagtttgaaacagttatcaaagatctcacatcaaagaaaagccaaggacatgatggctgagctgctaaactctagcaaacgtttaaagaagaactaataccaatgcttcttaaactcttcagaaaacaaaaaatgaaaaggaggtaaaatttccaaacactttttacaaggccagcattaccttgagaagaaagccaaacaaagatactacaagaatgaccatagacataaaaatcctcaaaaatattagcaaactaaattcaaaaacatattaaaagaataattcaccatcatcaagtgggatttataccttggattcaaggatggttcaacatatgcaaatcaatcaatgtgatacaccacattaatagaatgaaggacaaaaaccatataattacgtcaatagatggaggaaaggcatttaacaaaatgtaacatactacaaactctgaaaaaattaggcataagaggaaagcgcctcaacaaagttacaatgagccaacagctaacatcttatgcaacaatgccacattgaaaacttttctcctaaggtgaggaacaagacaaggatgtccactcttgcaatttttattcaatgtagtactggatgtcctagccagaggagttaggcaagagaaagaaataaaagacatctaagtcagaaaggaagaagttatttgtctctgtttgcttgcagatgacattaacttattcttagaaaacaatgaagactccaacaaaaaagaacacttagaactaataaagaaattcagtaaagatgcaaggtacaaagtcaacatatgaaaatcagtagcatttgtatgcactaacaatgaactatctaaaaaataaatcaagaaaacaattccatttataatagctacaaataaaatacaatacttaggaatcaatttaaccaaggaagtgaaagatctgtacactggaaactataaaatattgaagaaataaatggaagagggcacaaataaatggaaagacattccatgttcacagactggaagaatcaatattgttgaaatgtttatactaccaaagcaatctacaaattcaatgcaatcttcatcaaaattccgatgtcatatttcaaggaaatcgaaaaaaaatcctaaagtttatacggaaccacgaaaaacccagaaaagccaaagcaatcttcagttaaaagaacaaagctggaggcatcacattacctgattttaaaatctacaaggatatggtaattgaaacagcatggtactggcctaaaaacagacacatagacctataaaacagaatacggagcccaggaataaatctacacatttactgtcaattgattttcaataaagacgccaaggagaaacaatgaggaaaggacagtctatttaataaagggcattgggaaaactagatatccatatgcagcataatgaaattagaccctcatctcacaccgtatgcaaaaataaactcaaattcattaaagacttaaatgtaagacctgaagctgtaaaactagtacaagaaaacataagtgaaaagctccatgacattggcctgggcaaagatttttttacatgaccccgaaagcacaggctacaaaagcaaaaatagacaaacaggattacatcaaactaaaaagcttctgcacagcaaagggaacaatcaataatgtatggaatgggaagagacaacatatgtaatgggaaaatatgtttacaaactatacctctggtaagaagctaatatccaaaacgtataaggaacttaactcaattataaggaaataacccaattaaaaacaggtaaagtaactgaatagatatttttctaaagaagacatgcaaatgtccaatggctgtatgaaatggtgttctacatcactaatcatcagggaaacacaaactaaaaccacaatgagatacatcatcttattcctattagaagggctattataaaaatatgtgaaaaataagtgttggtgaggacgtggagaaaaggaaaccctttttgtgcgctataggtggaaatgtaacttagagtcataaaaaaccagcatgaaggttcctcaaaaaaactgaaattagaagaaaaatataatcctgcaatctcactactgggtatatattcaatatactgacgagatatctttattcccatgttcactgcagcattactcacaatagccgagatacgtaaacaacctaagtatgcatcagtggatgaatggataaagaaaatgtgatacatatacacaatggaatatcattccacttttaaatagaaaaaaattctgtgatttgtgacaacatggatgaatctggagagcattatgcttagtgaaataagcaagcacagaaagacaaataccacatgatctcacttatatgtggaacacgaaagattcaaactcatagaaaaagaaagtttaatggtagttaccatagcctggagggggcgcggggagattgaggacatgttggtcaaaggatacaaaatttcaattagatgggagaaataaatccaagacatgtattgtaccacatagtggctacaattaataacaatatattctatacttgaaaattgttaacagggtagattttaagtgctttcaccacataaaaatgatgtttgtgaggtaatgcttatgttatgtagcttgatttagccattctaaagtggcatggtgtataccgtaaatatacataatttttacttgtcaattaaaaaatacaaaataaattttaaaaaatcgtgagacaccaagacagaaatacaatagaagaatgggcaaacaatttagaagatacttctaagaatatatacaaatggaaataaacatgttaaaaagcagctcaatctcatttttaatcaaagagaagaaaattgcaactgcaatgaggaaccactaaacagacttcggattggaaaaaatttgacagtttgacaactggtaaaagctggtgaaaatgcagagaaatacgaacacacatacagtgctgatatgagtataaattgttcaactatctcagacatcagtttggcattatttaataaagtgatagatgtgcctattgtacaaccgagccattccaatcttaggtgtaaccagactgaaatgtgtgtacatatgcacccaaatatatctgcaagaatgtccatagtattgttcaggctcatgaacatatccataattatgcccatcatcaggaaaataaacaagtcaattatggtttatttatacaactggatcccacacagcaatgaaaataaaggacctacacagtacatgcaacaacctggataaatctcagaaacataaaattgagcagacaaaaaacaagacatgaaaaaatataactgtagtatgactcatttcacataaatttccaaaacaaataaaactaaactaggtatttacaaataaaacgataaagaaaagcaaatatggcattgtcacaaaactcagaattgcagttatctctgggtggaggcagtgagttgatgaaattgagaaaaggcacatggcttctggggtactggtggtatggtagtcttatcttgtgctgtgatattataaaaaatgtgtgatctttataattgttatgtcatgtcatgctgtgttatgtcatgatatgttaaattatagtagttattgttgttatatattttatgcgattttctctagggatgatacatcttgctacacatatgtacacaaaggaaatgcatttaaaataacaaaaaatttggctgggcgcggtggctcacgcctgtaatcccagcactttgggaggccagggcgggcggatcacaaggtcaggagtttgagaccaacctgaccaacatggtgaaacctgtctctactaaaaatacaaaaaaattagttgggcatggtggcacacacctgaaatcccagctactcaggaggctaaagcaggagaatcgcttgaacccaggaggcggaggtttcattgagccaagatcgtgccaccgcactccagcctgggcgacagagcaagactccatctcaaaaaaaaaaaaaattagtgaacacattcatcacctcccgtgctgtgcactgttaatttgattgtgataattgttatacaatgtatatgtatatcaaatcagcatgttgtacaccttgaatatatacagtctttgtcaattaaatatttttaaataaaaaataaaatgagaaaaattttagaactcagaattttaaaaattgaataggaagcttaaaatggacccacaatgaaaacatttcaaaaaatgttagagaaaattacatatccacacacaggagaataaaatgggaccctcatctcacaccatgtacaaatatcaactcaaaatggattaaatacttatacattagacttgaaactataaatctacttgaagaaaatatagaagaaatgctctattacattattctgagtaaatatttcctggatataactccaatagcacaggcaacaaaagcaaaaatagacaagtgggattacatcaaactaaaaagcttctgaacagcaaaggaaacaacaaagacgcaaactacaaaatgattgaatacattttcaagccatacaactgataaggaattaatatgcaaaacgtataagtaactcagaaaaatcaataataagaaaacaaaaaatgtgatttttaaaatgagcaaagtacccaactacgtatttgtgaagaaagacgtacaaatggccaactggtatatgcaaagatgctcaacatcagtaaccatcagggaaatgcaaattagaactacaatgaaatatatcacctctctcttgttaggatggctgttatcaaaaagatgaaagataatcggtgttggtaaggatgcagagaaaaggggacccttgcacactgttggtgggaatgtaaattagtacaaccattatggaaaacagtatggaggttccccaaaaaactaaaaataaaattatcatgtaatccagcagtctcacttttggatatatatccaaaggatattaagtcagtgtgttaaagatatatttgcactcctgtgttcatttcagcattattcacattatccaagataggactcaacccaagtgttcatcactggatgcatggataaggaaaatatagcatatatatacaatggaatactacttagtctttataaaaagaaggaaatcctgttagttgtaacaacaggtatgaacctggaggacattatgccaagtgaaataagccaggcacaaaaagacaaatactgcatgatgtcattcacatgtgaaatgtaaaaaagcccaactcataggaatagagagtacaatggtggttaccaaaggctgtgtgggggttgggggtttgggagggaggatgagaaacggggagatgttggtcacagggtacaacattttagacaggaagaaaaagttttagtgatctattgcccagaattgtgactataattaatcatgatttattgcatatttcaaaatcactaaaacagtagactttaaatgttcttaccacaaaaaaatgataagtatatgaggtgatggatatgttaattggcttaacttaatcactccgtaatgtatacctgtatcaaaacatgacattgtacacatacatacatatatttattagttttgaattaaaaattagcctcttttatttaaaataatatacaacgttggtactggtaaaattaaatgaacatttttgtatattccttttaagagttaaattggtacactttttaaataaataatttgaaaatatttagaaaattatgccttttgataaggttcttttgatgagaaacttatcaaaattacgcctttaaaaaataacaatttcactttttttttttattttattgttactatactttaagttttagggtacgtgtgcacaacatgcaggtttgtacctaatgctaaacaatttcacttttaggaatatgacctaaggaaatcacgtcatgttatcatataatatatgctcataattttcaaataattattaaaatatttttaaaacaatagagatatagttaaatacaatgtagtgcacctaagtgaatacatctgtgattctactttaaaaaaaacaaataacaaaacaacaagaagcaatgtccagcccagtgtagcattagtatcaacctaagaacttaaaaagcataaagctctggggatgatacccatggaaattcacatgaaattggtctgaaatgagctctgtcctttggtaagttttaaaagctgcccaggttattccaatgtgcatgcaggtttgagaaacactggattcttagacatacacgcgtatatacatttgcatgtgcacacacacaatacatgcaattgaaaagaagtttagcaaactgtaaataattttctcttgattaaagaatggatcattattttcttttctgaacttgtgtgcattttaacttttaacaataagcatgatgatatgcaactaaggcagccattttgtatagtatatatagtacatagtgtttatttgaaaacagggtaggtactctatgtgtttcaaacatttcagttgaaatcttatttacagaaataatttattcttaatgatcagggccatttcagcccgccccatctcaatgtatcacaaactctacagtaatgaatagcatgctaattactgattatgtacagtcatgtcttgttgagtcagagctacagtttaacattcattattttatgactagctggatttgaggcttttaggcattatttttcagatcagaaaaaaatacatcttgcctaaaaggaaaattaaatttaaataaatagacttcatctaattattccattattcctgagtgattttttttctcagtgttagagacatcagtctgttcacacatattttattagatccgagcaatacatttaatctctcttttctggatccacccacgctcaaaactaagatttcatttagaaaatatatttgagtacctaccgggaactgtgcaaggtgaagcagatatggtactgaaccaacagtcatggttcctgaacttagggactttctctttagggttcatacttataaacaacaccaagcattgaatgctaaaacagagagttttatgagagtgtataccacagcaaactaatctagcatgaggactaaaagaaatccttcttgagaaagtggcatttaagcttgaacctgaaggatcagtgaagagttactcaagaaaagagtggtgtgagaggtgtgctaaggatagagagcagaatgtgcaaaggacctgtagggcaggaagaaacctagaagatcagtgtagctgcagcataatgaaggatgaaatagagaagtatgaaagagacaggtcatgcattgtaagtcatttggaggattatgttctttgttctaaggataatggatatacactgaagaatttaaacagaagaatgaaactatcacatttgcaatttaaaaaaatcattgccattctatggggagttaatttgagaggaacaagacaagctttggggagaaaattggatttggggagagaaaataagacactactgtactggttcaagagagatacgatgggagtggagagattgaatttgagccataatttggaagtagcagcaacagaacatgaggataaattaaatggggaaaggggaaaaacaagttgcttcaagaatggcttttggatttttggactccaaaaatgaggagacactagtacaatttacagatatgggggagagtagagaagaagcagattgattggctagaagtgagaataagaagtgcagttttgtggatgtttagatacctatgagatagccaaataaagatgtcaagtagtcagttggatacattggcttagacttcagaaattaatttgtttgacagctatcagaatatagaagatatttaaagatacgggacttgattcttagagagagagtcaagactgagacctgagaacagccagtatttcaagtttgcttgaagaagacagtagcccacaaagagataaagaggtagccagagaggtagggaaaaaacagactatgatgtcacaaaagttaagggaagataatgtttttatgaaggaggaggaggccaattgatctatactcctgacaagtcaaatgaagagtgaattcaaccatgtttatcagatctaatcaggtgcagggtattgtgaccttaaaaaagtcattgtagttaagtgtgtggacagaaacttgactggagtaaggagaaaaataaataaaaccccactaagacaacatgtacatctaataaattgaccatattatttgggttgatttgctttatgaccccattttcttcaataatgggagagtctagagtatgtttgattggtggtggaaagatccaatagagaacatgagtttgaagttgcaggagagaaaatggagagctgatggaatcatgactttgagaagggaaaaaggttagagtacacatgcaaggattgctattcgcagaagaaaaactccattgtaacagaagaggaatagatgggccgcaaacatttgcttctagtaaaaattatttgacttcctaaactaagacattagttttcccaaaaatgtgaaaaactgaaaagaaaatgctttagcaccacttttacctaagttacttcattaggtgaagtttcattaccaggtatgaaagcaaagcttgttctctggcttcacgtgtccccaaccagtttctaccttgagttgtcaattctctgaaggatttctagcctctctacttgcaaagaagggatttaaatagattgcatctattctgtatgaattatctgaataacattcccatctcttttcatcaggaacttggacaatggtatttagggacccatttctcattcttcctactactactatgaaaataagcctgcagcactaacatttccctatgcatttaaaaagatttcttaagaagaggagtagaaaactgtaatagaaacattttaaggacttctcccaagtttcttttaggttcttagagtatatggggcaaggcttattttcacaatgaaaaaaaagtcacatgcaattaaacatttaggcacttccaaaaagaatactttcagggaagaaattatatagacatgggaaatgacttttaacgcaaagatgaagctatgctgtgtaagtcatataaatgcaaaagttgttaaatgtggtgtttttataaaggcatattaaagaaaaaaaagcccaccatagacattagacagggatccggcacagggccttgaagaaagcacacaaattcaggagcttatcttcagatttctaagtctagaatcttgattatataaaatgttgaccaacctaagttatagaaaactgattatgagccatatatcccatttttatttacaatgaataaatcatagttgaaaagataactgaaaatgggcatttacttgctcagtgccctctctaagtaccattcaagaaacaactttcagtttgcttggtctgactagaaataagacaaatggaaggagaggaagctatgatttaacttgagtgcagggctacctttctccactctaggcatacatttctctagaagacagataggattctatgatcaactttttccctagaagtgatagatacacaggctacttgcttttgaaaaaaccattttcttttcttgaggaccacctgcctatcctgacatgtaacagtcacaggattcaatgcactgtactccctcaaagtattttccccttgacaaaaccatgatgccagaaggttataattaaaattaactacagaagctggacacctaattacagccatcctaaagttgatcattaccattctcatataaacgcctctccttttttgctacaaaacaccggtcccccttgtttatttcttccccttgattccaacatagcaacttcatttcttatcaagcctcgacccacaactttgacatatcaattgaagctaaagcagctacatttattcttttagttctttttgtttcatgctataaagctcccttttcaaggcccacttgccactgcaggtcctacaatacctcttttgatgaccaagctccatgctaaggcttcccaccagacaattccacatccttgcatatttcacagtataaatatagaagttccctttcattccttgccattaataacaaaaatgtgaaaaatagatttcttcttaggaacaatctcaagatataagtggcttctatccaatatcttggaattcagggcatgtattctgccacagtgactcatatatatccttaagctggtacagtttcactgtaattggtttggttacatttgttatgacatggccaaaccttgagtatgggctttagacatttattttggacttgagtattccccaatatttttatggataaattgataaaaactcctagcattaataaaacataaattttaaagaagggtataatcatgattctcatacaaacatggggtaaatatgtgtcaaagattgtatttaactctttagttaatgagggaatcagtaagacggtacaaccagttcaaagcaaaatccaaaaaaagacaaatatgtatgctgtttccattcatttgggctgccataacaaaatatcataaattgggtagcttataaacaacagatatttatttctcacagatctgggggctgggaatttcaacatcaaggtaccagtacatttggagtctgctgacggcactcttcctggttcaaaaacggtaacttcttgctgcatcctcccatgaacacccgtgggccaactttataaggatggtaacagccattatgggggctctgccctcatgacctaatcacctcccaaagatcccaccttctaataccatcaccttgagggttaagatttccatatatgaatttggaagagacacgaacattcggaccacagcatataccaaccaagaatgatgaaacgaatttgcttaattgatacataattgatcagtaatcacagagcagtaatcaattgcattcctcaatgtacaatttgcatttctatggacatgcattatttgccttattattagctttctacactttataatgttgaaaaaaagctcaaagtaaatgaaagactgatataaccatgtagggtgctctagaaaggacattcactgaattattttccccaatttcaaagtcctctacaattttttatgacagggtagagggtagtgggtcttataacactttcttgtgtcctcttcttacatttttttaaaccttgtctccaacttttgggaggatttttcagaatcttttataccagctacagaaagcagaaaaaaagagaatattatttttaattaaatatttcattttgaaagcattgtagagtcacatgcaagtgttcaggaaaaataactaatgggtactaggcttaatacctgggtgatgaaataatctgtacaacaaacccccatgacacaagtttacctgtgtaacaaagctgtacttgtaaccctgaacttaaaagttaaaagcgtaacatggagatactttgtgtattattaactcttttatccattgcaacatctttcaaaactacaacacaatatcacaaccaggatattgacattgatatagtcaagatacagaacatttccatcacgacaaggatccctcctgtagcccttctgtagtatagccatgctcactttcctcccacctccggtacctccttaagccctggaaatcactaatctgttcttcgtctctctaatttgtcatgtcaacaatgttatatacatataattgtgcagtatataacctttcaggattgtcttttttcactcagcaaaattcttcaaattgtggaaacaggcacattcctccatagatcaatagtttgttcctttttattgctgaacatcattccttggtatgaacgtacccctgtttatttaagcattcacccatgcaaaaacatctaggttattcttgtctactataaataaggccactataaatattccactacaggtttttgtgtaaactaagtcttcatttctttgggataaatgccaggagtgcaattgctgggccatatgatagttacaatttcagttcttcaagaaaattctaaacgttttctagagtagttatagcatttcacattcccaccatcaatgcatgagtgatccaatttctccacatctttgccagcatttggtgctatgactatatattttttaagttttagccattctcatagctgtgtaataatattttattgtggttttagtttacatttccctaatggatgcaaatgttcaacatctttttatatggttatttgccatgtgtataccttctttggtgaaaagtgtcgtgtgttttcctcatgttctcattggattgtttgcttctttactgttgagttttgtgagttctttatatattctacatacagtcctttgtcagatatgtgattttcaaatgttttctcccactttgtaacttaccttttcatcatattaacagagtattgcacaaagctaaaactttaatttgtataaattatgatttgtcagtttttccttttatgaattatccttttggtacccagtcaaataatacttttcttagccttagatcctgattattattacctatgattattttccagaggtttgatagttttgttttgtttttgtgttataattaagtctgtgctcaattttgagttaatttttctataaggtatgaaacttatggacaaccaattgctccagtaccatttgtttaaaaggctatctttcctccactgaaaatataactataacttttcaatatctaataaaacaaaataaaataaattttttaaaaacagcttggcatatatgtgttggtctatttctgaattcttatgttccattgatctatgtgatctataccacataatcttgattattgtagcaatatagtctttaaatagcatagactgattcctcttacaatattattctttttcaaaatggttttagctattatagtactttgccttcccagatacattttagaataatgttgcctatttttacaataaagcttcctgtattttcatagacattgcattcaatctatgtattaatttggagagaattgacatgtctctccatttatttagattttttatttccttaatcagcattgtgtaattttaagcatcaagtcctgtaaatgttttgttacattttcactaaagtatttctttttggggtacttacacatagtattatatttttaatttcaatgtccaagtgttcattgctagtatatagaaatggaattgacatttgtatgtttatcttgtatcctgtgacattgctgaactcatttattggttctagtaagtttcagcgattttctatgtagacaagcatgtcatctgcaaacgtaaatcattgtatttattaattcatttcatatctttatgccttttattgccatttcatgccttgttgcactggctagaactttcaccactctgttgaacaaaagggtgataatgaacaaacttgcctttataccaatcttaagagaaaagcctgtagtctttggcatcaagtacaatgttagatgcagggttttggtagatgctcactaacaagttgagaaagttctctattcctagtttgttgagagcgttttaaatcataaacaagtgttgacttttgtcaaatgttctatctatattgatataatcatgcgatttttcttctttagcctaaatgacattattgatttttgaatactgaaccagcgttgcatctctggaataaatcccacttggttatacggtataattctctttatacactttgaattctattcactgatattttgttaagaatttttatgtctacagtaatgagggatattggtctgtagtgatattttggtactgcgcttgtcttgttttgttgtcagagcagtattagtttcataaaattaattgtaaagtgtttcctacttttctgtttttggaaatcgattgtaaagaattgttgttaattcttctttaaatgcaaggtaggattcttcattaaagccatacagtcctcggattctctttgtggtaagttatttgactaccagttctgtttccttattagttgtgacagtttgtgttttttgagaaagaggtctattctgtgtaatttgccaaatttatgtctgtatacttatctgtagtattcctttgcaatccttttgatgttttcagtctatagtgctacctggtatcactcctgatattggcaatttatgccttctctatttttttctttgctacccttgttagatgtttgtaaattttatatttctcaaaaacttccattttgtttcctttattttatctattgattttctgtttttgatttcatggttttcttctaattcccttctaaggacccattgtgattatattgggcctacccagaaagtccagaacattctcatctcaaacttcttaatttaaccacctctgcaagtcccttttgcatgtaaggtgacatattaacaggttctgggcattagaacatggacatctttgtggggtcattattttatctaccacagtctaccctccggccaacaaaaatgcatgtccatcagcgtgcaaaatgcatttaccctagttcaaggtttctaaaaatctcaactcattatagcatcaactcaagttcaaaatttcatctaagttttctcagcttaaaagttcaatatttcatcatataaataatctaaatcagttatgagtcaggctatgggaataatccaacctggtatgtttttttgtctgtacccattggtgtttcagggttgccagctttttcagctccaactctggggtatataagttaaaaagaaaagcaaaggaactcactactatgccattcctgaggttgtgagattcccagaagatcatcctcctttcattcttttagattcttggtatgtttgttttatagatcatatttagggtttttagttgaatttaataggaggaagaggaaaaagcagatctatttcatattcttggaattgtaatcccaagaaagcatatttgtaaaatctatctaagatactttatgtatgattatctattcttgtgattttgctgtcaaattctatgcagcagcatttttccccaacaaggagttccagttttttccattagtcatcagtatctaagtatattttaaaattttgatcaacaggataaaaagacacttatcctgctgcaagtacacttcagagtattttgaaaaggattctgtagatggtaaggaaatcatatttaattaatctaggtcttttaggcatcttggttaatgaagataaaattaattttttagaaatctatgttatctttcaaatttatctgaaatttattctgtaaatttaatttaaaaataattatggtcaacgccaactaaaagcttctctaatcattcatcactaatttaaaaaatgtaataaaagtaaaattactgatcaaagtaagttccccaatttggagaaaggtgtatttttttaaagtttgacacatgttatgctcataggcttgaggaataacccttagttgagcacatattccaagaatgttattcatgagccacaaaatttagtcagttagtatatattgagtgcaaattatttttctagttctttagagacacggagtatgtgccaattattgcagaatatattaagtctcaggcatagtgttctgttgtgcttcaaaaagcactggaaaaatttatggaaaaagcattttaaatattaaattacatataaatatgtattactgaagcgttttcttttaatttttattttgaaaacaacttcaaatttacataaatgttgcaagagtaagatgatgaattttcaaatataattcagctatatttattaatcattaatatttggctacatttgttcccccttgtctctcactcactctctctatatatcatataataaagtaataaacaccatatttcacattataaataatatactatatttaaataccatattttgtaatattataaatgtactatatgtattaaatattttataatgtcatgaatagtattattattagttttgctgagttattgagtttaattatttgccaggaacataaccctttactcctaaataccttagcatgtatatccgaagaaaaagaacattctctgaaaagtactataataaattctgacagtttaatgaaatattatctctatatatcatgcatattcaattattatcgactgtactaatagcattctttatggtccagaagttgtctaggatcaccactgcatttagcggtcataactctttagtcattctacatggaagagctcctcccagtatagaccagttgttttgtaaaatgatccccaacttatgtctgtctgatgatttctcatttttttttactaattcttctttgttatattaaaaacactttttatattagtatttgatttttaattgacaaaactatatatttacagcatataacatgatgtttggaaatatgtatacattgtggcataattaaatcaagccaattaacatatgcattacctgacatacttattctttatttgtggtgagaacacttaaaatcttcattcttttctacagcttcatagtactccatagtgcagatgtgctacacatagctcattcagccatctcccataaatgagcattcagtcatttcccatatgtgcagttgcaaacaatgctgcaataattaatctagaacacatttattaatgtattgttggaagtataaaacgttttaagtggtttagttacaaggtctataacaataagaaatcttgagttgaattttaaaaattcaaacaaaataacaccaccatcacatacccacctgtgatcctaaatcaaaccagaaatagacaagaaggagtaaggtctgtgaagaccaaaataatcagtataaccatgtcacaagtggggtgcccaaaaaaatagattctaagacagagattagcatgcaaagggtttactagagagtgcctttgggaatcaatatctgtggaaggaaatagaagggaagaaagcaacagtgggcaaagagaagttggactgcaaggcagcctcaagggaaagcctcgatgaccttactgggaattctgaaactagaatgacccttcagaatttttacaaactggcaagggggccaggcccttacattttcccatcaattggtcattggatgtaggccgcctggaaaggaggctctaccttggacaaactagctctcttcagcagaggcatctttgtaaggagatgacagctgtggactttctgcaggcagcactctcagctgctgcgggtattagtttttgatttctaaaccagaatcttagttgtacatcacagcacccaccacagaccagatatacctggatcaatgaaattttaaaaaataactatttactcctttctgccttagctctttcttgagatttgaaagcttttcacatttctctatcataatgaataccatattagattcatcttctttacttgtctggtttctctgaacacattttattagttgttgtatccctaatagctaccatggtgcctggctaagcacaagtgttcaattattatttaacgaaagaacaaactccaatccgtaatgatttgaatgatcttaccaaatgattaatgattatatacacctgtctgaatggagattttagtgtctagctagaggccctgacttatgcctattcaaaactacggtttaatcagtggtgaggaggaaggtatagcaagtaaatgttccgtttgtgaatggcatgaaactaaggacagtagcttcactggatgacagtgaggattcacaaagaatgaacataggctaagataatggtctgaatataatgagatgaaatttgaggaactgatatgaaggactgtcagtggattcaacaaaccacccagaaaacttttcagctggctaagcagaagtttctgagaaagactaggggtttttgatgattgcaagaccaacaaaagtcaacaccattatgtagctacgtgtcatcttagccattatcattatatatatatatgtgtatatatatatatatatatatgtgtgtgtgtgtgtgtgtgtgtgcgtgtgtgtgtgtgtgtatatatatatatatatatatatatatatatatatatatatatagcttgtgtcatcttagccattatcagtatatgtatgtatgtgtgtgtgtgtacatatatataatttaaagcctggaagcctggaagcaatggcccgattcttggtcacattgccataacatccaagatttcaattccaagccgctgccatggagtataaggaccagacaatttagaatgtatttggaggaaagcaagtagggtggtggaaggacccaaatttgcacaatgaccaatggctaaggggaggttgggggaagttttgccaaaccttttaggcacaaaaattagcttaatagaaaacctaacaaatatgaacaaaatgagttaatgaacatccctaatgaacgtagctgaagaaattcttcaaagatatttacaaactgaatccagcaacatgttttaaaaaaaataccgttacatgtcattgccttcttgtaatgtgcttcaatattggaaaggctatggatcacatcacaatgtcagataaaataaataataattcagtaggcagtttaaaaggcaattgatgaaatgtaagttcatttatgttccaaaaattaaacaacaaaaatcccaaaagctggttaaattagaaatacacgagcagattttaaacatgatggtttatatatttctcatattgatggcacaatgctaactggtaaagcaatacatgttttcccactcgagtcaggaatatgagcaatatgatgattctcattacttttatttaacattactcaagatagaagaccagagaaatgaataggttataaatatagaaaagtattccttactgtattccaacattatcattgattaacaatgatagaattgcttgtcctataacagtaacaataaaaattgaaaaatacttgaattattaaaatattagtaaggaagttagtttcataataaatatacaaataaaatacaaagagcagaaaatctagtgagaaggtaaaatcaaaaatagattgtcttcagatttaacaataaagcataaagtaccccagagtaaactggataaaaaatgtgcagggtccataggaagaaaactataaaacttgactaaaggccataaagaacgcttaaataaattgaaaaaagacaaattacgttgtcggttagaaagactaaatacgttgaagatgccagctatagccaaagtattctctaaatcaaatgtaacatcaaaaagccagggacttttacttcaaactttgtaagatgttcactttgaccaataaaaagtaggaataagaaagaaaagaaacattttaaaagaaggatttgcctaaccagatatcataatgtgctctagagtagttaaaatactgtagtaatattaggggaatatacaaaccagaaaaagagcataaaaattccaggggaaataaatatttaagaatcggttatactaacataaactgaaacaataaagaaaaaagatactgtaatgacgtgctaaagaagaactattacagaaaaacaagttaaccttcacttaaccccaaaataaattgtgagtggataatttgcattttaaatagagccttataatttctagaaaaaaatattatcttaggtctaggggatctttctaatcataaaaacagagaaactattttttaaaagacataaatttaattttacaatattcatgtttaaaagttacaagaaataattaaaagaactaaaaagcaaaattgaagccagaggaatatctgaaaaaatgtaaaggataaatagttttatatataaataattccttaaaaaaataataaacccccaacagagaaaaagcgacaaatggcattagtgggcaaaggaaaactacaaatggtcaataaacatacaaagttgtttcaatctctctaacattgaaagtaacgcaaaaatattttacctacattcattatttcattcaaaatacaactatttatgaccaactttatgccaggtattgctgtgggtcactaagaatagggagccgaatgccaccatatccctgccctcatgaaaaagaaagagatagtaatcaaattaaaaataaataaataaaaaacaggccgggcatggtggctcacatctgaaattttagcactttgggaggccgaggcaggtggatcacttgaggccagaagttcaagaccagcctgggcaacatggtgaaaccccgtctctactaaaaatacaaaaattagtcaggcatggtggtgcatatctgtaatcccagctacttgggaggctgaggcagaagaatcacttgaacccgggagggggaggttgcagtgggccgaggctgcaccaccgcattcttgcctgggtgacagagggagactctacatcaaaagcaacaacgccaacacaaacaacaaacaaaaagcagcagcacatataaagttagttatacaagatgaattagttccagtgatctgtaagatagtgcctatagttacgaataaagtaccctatacttaaacatgtgctcagaaggtagttcatgttatacgctctcaccatccaaaaaagaaaaaaaaagtaaccaaaaaaggaactcaagaaaacttatgtacgtgctggatatgtttgttaattagattgtgctgatggtaacatgagtgtatatatatgtccaaactttccaaattatgcgtagtttttgcataccagttgtatctcaatgaagctgaggaaaaaaatacaaaggaacatacagacaaaataaataacagtacggtttcaaagggtgatacttacgtgaagaatgtaaagtaggataaatggatagaaagcaactgagagaactatttaaatgggagaaaatgaacacaatctttttgaaggctaatctggcagtgtgcatcaatagttttacaaatgtccatacctttaaaaaaaattttaccttaaaacaattttagactcgcgagaaattgcaaaattagacatttgggactacaacaaagtaaaaagcttctgcacagccaaaacaatcaacaaaatgaaaagacaacttaccgaatgggagaaaatattttcaaaatatacatttaataaggggttaatttccaaaatatataaggaactactacaactgaaaaagaaaatgaataacttaattttaaaatgggctgaacacttgaataaacttttctccaaagaaggcatacaaatggccaacaggtatatgaagaggtgttcaaaatcactatcaaggaaatgcaaatcaaaatcacaatgagatataaccttgcacctgtaaagatggctattatcagaaaaacaaaagacaagtgttggcaaaaatgtggagaaattggaacccttgtacactgttggtgggaatgtaaattggtgcagccattacagaaaacaggaaggaagattatcaaaaaaaatttcaaatagaactaccatataagccagtaatcccacttctgggaacttatttataaagagttgaaatcaggatcttgaggagatcttaacattcccatgttcatggcagcactatttgcactagccaagatgtggaaacaacctaaatttccataaatggatgaataaagaaaatgtggtatatacatacaatggaatattattcagcctttaataaggaaaaactcctgcagtacgtgacaacatgaatgaactttggagacatgttgctaaatgaaataagccagtcatggacaaatatggcatgattccatttatatgaattatctaaaatagtcaaactcataaaaacaaaaaatagaatggtggatgccaggggaaatgggaagggagaaggaggagttactaaccgatgtgtataaaatttcaattatgcaagatgaataagttccagaaatctgctgtacaacattgagcctataggtaacaatactgtattgtacacttaaaaatctgttaagaaggtagatctcatgttaagtgttcctacataaaattaaccatttttttaattaaacaagaagttgcaaatatagtagaacattaatatgattgctttacctgctttttcttaatgataacatcttacatagtcatagtaaaataccgaaaccaggaaattgacataggtataatattattataatactataaactacatacctatttcaatttcacagttttcacatggactcatctgtgttttgggtgtgtactactatgaaattttatcacatctgtagattcatataatggccctcacaatcaggatacagaagtgttccatcaccacaaaaaactcagtcatcatacccctttatggtttatgttaccaactgtaacccctgaccagcactgatctgttctctatcaccataattttgtcactttgaaagtattatataaatggaatagagtatgtaaccttatgcgattgactttgtttcctcactcagcataatactctagagatccatctaagtttttgtgggtatcaataattcatttctcttcatgactgagaagtattcccattacatgaatgaacaagtttctttggataaacttcacccattgaaggacatttgggatatttgcagtttaggggatattacaaacaaagctgctatgaacatttgtgtccaggtgtttgtgtgcatacatgttttcaagtcagtacgataaacatccaagattgtgtttcctggctcctacggaaagtatacggtataaatttgtaagaaactgccacattgttctctgaggattgtaccattttacttttctaccagcaatatatggcagatccagatgttccacatcctgtcaatatttagtgttgccactgtcttctattttagctattctggtagatgtatactgttatcatggttttagtttgcatttatctaatggctaataatgttgaacatatttttatgtatttatttgtcctccgcatatcctctttgtttaagtgtctgatcaagttttttgccattttctaatgggattgctatcttacctttgagtttagagagttattcagatattctggttacaagcttcatgttggatatgtgatctgtagaaatttttcttacagccagtggcttgtcttctcatcctcttaatagtctcacagagtaaaagtttaaattttttaataaagacaaatttatcatattttcttttatggcttacgctttggtattgtgactaaaaactctgcttaactcaaatcatgaaggttttctcctgtgttttcttataaaagttttatatatttactgtttacatttagatctctgccatttcagttaatctttgtataaggtatgagatttagatttaggattatttttggtccacggataaccaattttccaacatgatttactgaaaatatcattcttcctccattgaattgctttttcacctatgacaaaaataagctgggtgtacttatggtgggtcactttctagactcttcattctgttccactgacctatgtgttcactcatttttctataagatgttgtcttgtgttcccatcttcctttttcttccccctttttttagagacagaggtctcactatgttgcccaggctggttttgaactcctggcctcaagccatcctcctgcctcggcctcccaaaatgataggattacagatatgaaccaccacatctggcctgtttctatcttttgattccacaataatttccaggaatttatccataagagataaaaataagaattctccataagacctagacatatgtgaaaaaatatacatgtaaggatgttcagtgcagctttttcacattgaactagaaataatatagtgtctaacaataggaaattaaagatttcagattccagcaaaaacggcttactcagctaatgcataaactctctccctataaaatgtagtgatgttgaataaacatttaatataacatatttaaaacataatacattttaatatatagttcacctcaaaaacggaactcttcaggaaccagaattgatgaggtccctgagagctagaattccagaagtatatgctgatattgttgtagccttgaacatgttactagcccaataataggagagttattattttaatgcacacaaaggcatggatgacaacagctttattcactcaagattggacacaggaactaagacctgggagtaaagctaagaaccttgaaagactgtgatcccagtgaagagaaaataaaaatgctccatgcacctacccattgagttcacaataaatcttcagagggaaattaaatcactgtgactggccctcacataggtagagtctgtgtattctaaactcagaggctaggatctaccaagtcaataaatgagcataaacatttgttctgggccttggatacccaaacagcccaacaggaacaattgcaaactctctggagaaataaccgaggctacaagagattcctcctaaaaaaacaagctcccctttagataagctaacaacaaaagttaaaaattatagatggaatcaccaaacatggcaaagacatcagacactacaaacaaatgaattagcattccagtaacttgaggaaaggcctacagatttttctgttatgattctataaccacactattcaatataaacataatacaagtgagccacaaatatgagttgcctatgcaattttaaattcaattaaaatttcacattaaaagagtaaaagcgccaggcatggtggctcacacctgtaatcccagcactttgggagtccgaggcgggcaggtcgtttgagcccaggagttcgacaccagcctgggcaacatggcaaaaccctgtctctacaaaaaatgcaaaaattagccgggtatggcggcctgcacctggagtcccagctactcaggatgctgagatgggaggatcccttgagcccgggaggcgggggttgtggtaagcctagatcgtgccactgcactccagccttggggacagagccagactctgtctcaaaaaaaaaaaaaaaaaaaaaaaaaagggaaaagaaataggtgaaactaattttaataatatagtttaatttttatttttgattttagctttacttaacatctttcatactaagtctttgatatttagtggctattggctatcataatggacagtgcaagtcatgaaataagtataaaatgggtaatatgacccattcattcaatcatgattcatcaagtatccactatatgccagacaccaggaaactttggtgcgctaaataaacaaagtgcttgccttcattgggcttaagtaataacatgagtgcaaaaggagaaagagggaacatggagaaacagataattaactagaaaatatatattatgctagacggtgatatgtattattatagagaaaaaccaggcagggtaaaactcataaagatgatgtctgtgtgtgtgtgtctgtgcatgtgtatgtgtatgtgtgtgtggtgcaatggtttgtggaagtattattttatatcaagtgatcagtaaaagcctcacaaataaggttatatttgaggagggtcttgtaaatcaagaaccaaatactgtagaatgtcttaaaaatatacagtcactgagattctttaaaagagctcaatgcatgaattcaacagaggattagacagagcagaaggaaggattagatctcaattcacaaaatacagcatgataaatattttgaaaactttccagttatgaaataactatattttatacaattgaccagaaacagctttttaaatttatgagtctatttataaaatataccgcctcaatcagcaccgtcaaatctaaatataatgcaagtcacgtatataactttgtgttttctagtagccacactagaaaagtaaaaacaaataggtaaaattaattttaataatatactttagcagttgaataatatatttaacccaaaatatccaaaatgttattttaacatgtggcactagccacattttctgtgcttagtaaccatatatactagtagctaccatattacacattgcagccctagatgcttcatcaattcttgcagacagccttttaaatgcttagctgaacacgaggtagattataccaaaaaattgaaaacaaaaaaaaaaagaagctactgtcgtggacattctagggaattttgcctttctcagaaacttctgttccttgagtgtttatggctgtgctgggattgaatgatatgccctttgactaacccagtcaatgagaggattactatttctatcctgaagacagacacagaaagaaagggacataaaaggaaacacagttgaaacaccaagagagtaacagggacaaagagggatagtgagcctatgcatgcacctacacacataaacacagacaggaggaatgacaaatgggtagagagagagcaagacaaagaagacagcctcctctcaagcccagattagaaattgaacatgggacctcctctctctccttgaagcatagggccctccacttcaagttgtgcctccagaagcaccactcggtggtagaagataccattgactgcagtgactgaaactcacaaacatgaattcatcaatttcaaccttactcaaggctccacttggctggagagagtagacttgaaatcaatgactctagagagtaaatgaaggagctgaattcagcagaagcatggaggtggctgcggaggtatgccttactagaattttaaaaatataaagtgtgaaaaactattttttcctcagaactctctaaatgaaaagccagatctcatatcttgggttcctcaaccaggaaatgtatactatatgtacactaaaataatgggcacaagcattgtacagacctgtttttaaactcagttacatttgacaactattgacttaattggcaagtacatgcctctgatataattctaaagtgtgatgtgggtctgtttggtaaccctaaaatgccttaactctaagcagggaccttgtttgaaggggcaaagtaacactataataaaagccccatggactgtgaatcttaagtgtgtatcctgagtctggttatatttttaagtagcagcatgaccctatcaaccaattatcctctcagtttacttgcatgtaaaattatcacattggatgagaagatttgctctggttttataaactatgattccacttctatatagaaaataatgataaacaaaatgtttatatattttattttgcatagaatgaaatagaataagaaaggtttgattcataaggccactctagatctttctaggtctgtcctctgcaaggtaactagataatctcacaataaataaattctcaggaaacaaaatgaattccaatttccccacttcaatccactaattgccatatgagtgtagagtctctgtatgttggagttataaaaaatggcagttgttaaacaatgtataaatataaaaaattataatactttacctttgaaataccagtggtcaagtaacttcataattaacctcaagaaaattaaaacataggtatgttcaaaaacagtttcccaacagttctttctcagttttccaacaccattcacagtggctatgcatcttcatttctaatgtcaccttttcagaaaccacttgccaccaggtcatgccttgcagctaagttattcccagcttcttccttacatctgacaagttttgcacctaaatgtctctgacttgtattggtggatacttggtcacagaggggctttgtttgccaccttcctaggttacaaaatctgtgatgcatatttcatgtatattattttgtttgtgcagctgctcaatacaaatacaatgatgtatacaatttgggggcttgtttcaatatgcaaacttcacagaagcctctgcccagaaccagcaatcagcaggaccagcacaacactgccaaaaattttacaaaggcaattcaaacaaccctataatttaacttttatttttatgtaataatgtttatatactatttcaaattgaaatgtaattagtttagagtctcataatgcagatttttgagtaagcatcaccgattttacaaagacaggcaaaggccacctaatattgaccagtacaattagttttctgattgacagctaaaccttcccatttattcaagttattgacactttcacgtgtcaagctgaaatactgttattctctgaactgtgaaatttcagagattgttccattctggaaacaaataaccatatgaggggagaatacttgaaggctactactattatttctaatactcacaaattcttaagtttgattcaaatgactgtcctgataatgggaaataatattgaaaatattgtgactttccactgttgaaaagcggtacgatatatataagttttgagctaggcagctgaatttgaagtttggctccaaccccaccctgcacaatgcctcatatagaatagatgctcactaaatattactttccttcccttattggttttccctaaagtcgagtagaaaaatgagttttgatgtaaacctatcagcaatgaggagttactgaaaatgttattttaacttgaaaaaatgaatatgatattttagataagagatgaagaaagagtggagtcaaggagattgattaatataatctggactataatggggacagaagaagcattataaaatctttatctacctacctacctacctagttatttatctatctataaccatttgtttgtttagaaagaacattcacatctccaacaagaaacttgtgaaagaggtatgattattctgttttcctagatgagaaaagtgatgttcagaggtcatttatttttcctaaggccaatataactatgtaactaagtgttggactcagagctttaagacaaaagatatctatgcttattcctataatatactccatctcatgagaatatcaaaaagcatgaggctgaccactggatatggattggaaggtgggggataaatcaaatcatattcaaagttttttagtagtaacaacaagggacaaattaaagtcaaagaaataattgggatggtatggggaatgtgacaaggagatcggtgaatagttagcttgggatatactgatttttttttttttttttgagacggagtctcgctctgtcgcccaggctggagtgcagtggcgggatctcggctcactgcaagctccgcctcccaggttcacgccattctcctgcctcagcctcccaagtagctgggactacaggcgcccgccaccacgcccggctaattttttgtatttttagtagagacggggtttcaccattttagccgggatggtctcgatctcctgacctcgtgatccgcccgcctcggcctcccaaagtgctgggattacagggggatatactgattttaaagtggggtggggcatccaaacggagcttccactaggcatttggacatgtggggttggcagagtatcaggcttggctctatagaggtatacagtgagaaagaatgctataaaaacggacatgaactgtgagagggacacgctcaagtagagggccaacaacagtaccgacttgacacccatatttaggcaaaaagaggaagtaaaggaatcagccagaaggatgatgaggaagtaagcatagatatgaagaaggatgttcagcatagaaaccaagagaggaataggaggattgttactttttgagcatccaccaagtgtcaggcacttcacctataggttaattcaattctaaaacaactcagtagattcatgtgctgcattatctatattttttagatgtagaaactatggtcaaagaggaaatctgtcctgttcaagaacacacataagaaaatcctgacaaatttcaggatttcgacttagtactgtgagactccaaatctcatactttttccagtttgcagaggagggaatagtcactagtgactaagtgctgatgtttatcaagaagcaacgtcacagttagctctcagtttcgggtatgtctttatcagcagcgtgaaaatggactaatacagtctccaagcagcttcctatgttagtccaggggcccgtgattgctgaggagacatcccattggatgggcaattagagagagtactggggatgggactgcaatttcaagtagatagggtttagtagggtataaaaaagtgaaaatatgttggagatcactctctgaagaagttagacaatgacggcaagaagaaagaagagataataaatacaggagagctctgatctgaagataccacctctcactttactttctatactggcgattccagtccttttgtaatttcatggctgaatgaaagtggtaaaactagaaggtccctgccaatcatctggtctctttgggtggtagataaggaaacagttttataggggttaaatggcaggcccggacagtcaggtcccatgcagagctgggtggacaaaccctagtctcttgactcctagtttaatgcttttgtggaaagtattgactatagcacaatacttcatccatacgtcttcctcaatctagctcacacttggatagcatttactttacctaaaaatattctaacccatatctccatcaacctgtagtccagatagaatttggaagatttcctgcaaggagaagtagcaagggaaatgattaaaaatatataccattaagaatgcatagtacatgtattagtccattctcacattgctataaagaaatacctgagactggataatttataaagaaaagaggtttaatgggctcaccgttctgcaggctgtaaaggaagcatagcagcaccggcttctgaggaggcctcaagaagcctccagtcatggcagaaggcaaagcgggagtaggtgtctcacatggcaagagcaggagcaagaaagagtgtggggaggtgccgcatacttttaaacaaccagatctcatgagaactcattcactatgatgaggacattaccaaaggaacggcactaagccatacatgaaaatccaccccgacccctgccatgatccaatcacttcccaccaggtcccacctccatcattggggattacaattggattacaattcaatacgagatttaggtggagacatagatccaaaccatatcggtgcatattttagttaacttccagaatttcacagctatcttttctaaacttcaatattcaaagaatccaggatgttatttagcacagaacaatcatagtttttgtattatccaccacttgttttacttatcagcttttttccttcttccttagaatttgaaattccttgaaagtagcaactgctttatgtgtttatatatttttttacaagagctagcacagtacagggtacgtgttggacaatgaatacatactttttgaaagattaatattaatacatagatgtatgaactctttggaacaattttccaaagtcatgtttttaagcagtcatgaattaattgtcccatgaaaagtgtgtgaaatccagttattttcacatttgagcacctggttcttacttgatgatacaaatggccaattctgaatgcagtgagacagggttaaggagaaaatcaggtaaaattctaagtatgatatctatttctttagttaatcattttctactagtaaaaaataaaacgttcattacagataacatgagcaacgcaaactgaaaaaaagaagaaaataaaaatcgcaaataaacccactatccatggataaatgcagcttgtattttatttccttttattctttttatacttataaacacatatgtatttttatataggaggacaaaaaacatataatcatctcaatagactaataaaaagcatttgacaaaattcaacattccttcatcataaaaacgcaaaaaactaggcatagaaggaacatactttaacataataaaggaataaaggtcacatatgacaagcccaacttaacatcatatttaatgagaaaaagctgaaagcctttcccctaagaactgaaacaagagaaggatgcacatttccactactcctattgaacatagtactgaaagtcttagccagagcaattagtctagagaagggaatcaaaggcatccaaattggaaaagaaggcaaattgtcccttcttcctgatgatatgatcttatatctaggaaaacctaaagactccaacaaaaaactcttaaatctgatgaatagattcagtaaagttgtagaataaaaaatcatcatacaaagatcagtcatgcttctatacaccaataataaactagctgagaaagaaatcaagaaggcaaccccatttacaatagcaacaaaaaagataatcaggagtaagtttgaccatgaaagttaaagaattctacaaagaaaacaacaaaacactgatgaaagaaattgaagaagacgcaaacagaaagacatcccatgctcatggatcagaattattaatatctttcaaatggccatattgcccaaaacaatctacaaatttaatgtaatccctatcaaaataccaacatcatttttgaaaaatagaacaatcctaaaatgtgtatgaaaccaaaaaagagtccagatagccaaagcaatccagagcaaacagaacagagctagaggcatcacactccttgacatcaaaatacattacaaggctatagtaaccaaaacaacatggtattgttttaaaaaaaagacagaccatagaccaatggaaaagaaaagagaatccagaaagaaatccacatatttacagccaactgattttgacaaagaaaccaagaacatactttggggaaaggacaggcttttcaacaaatgatgctgagaaaattggacatccatatggagaagaatgaaactgaatccctatctctcacaacatatagaaatcaactcaaggtgtataaaaaatttaaacataagacatgaaactgtaaaaccactagaagaaaacaaggaatatatttcaggacactggtctaggcaaatattttatgtcgagacctgaaaatcacggacaacaaaaacaaaaagagacaaatgggattatattaaactaaaaagcttctacatagcaaaagaaaccatcaacacagtgaagagacaacctgttgaatgggagaacatatgtacaaattattcatccaatagggggctaatatccagaatatacaatgaactcaactcaataagaaaaaaaaaatctcattgaaaagcaggcaatggatatgaatagacacttctttaaagaagtcataccaatggccaacaggcacatgaaaaaaatggtcaacatcactaattatcagaaaaatgcaaatcaaaaccacaatgtgatatcatcttaccccagtcagaatggttattattaaaaagacaaaaaaagaaaacagatgttggcaagatgcagagaagagagaactcaatgttagtgggaaagtaaattagtacagccattatgaaaaacagtatagagacttctcaaagacaactagaaatataactaccatacactcttgcaatcccactactgggtatgtatccaaaggaaaagtaatcagtatataaaagggatccctggactcacatgtttattgcagcactattcacaagagcaaagatatggaatcaacccaagtgtccatggaaagagtaatggataaagaaaatgtgttatgtatacacaatggaatactatcaggccacaaaaagaataaaataatgtcatttgcaacaacacggatggaactaaaggtcattctgctaagtgaagtaagccagacacagaaagactaactttgtatgttctcactcacatgtaggagctaaaagtcaatctcatgatagttaccagaggctgggaaaggtgtgttggcaggaagagggatgcaaagaggtcaatgggtacaacgatgcagttagatagaatgtttaagatctaatttttgaaagcagagtacggtgactatagttagcaatactgtattgtatatttcaaggtagctagaagagagaacttgaaatgttcccaacacatataaataagtactcaaggtgatggacacctgaaataccctggcttgattattagacattctatgcatgtaacaaaatattacatgcatctcataaatatgcaaaatattctgtatcaattgaaaaagggagaagactgagatacatcaagtatatttacatctattgactttttatattattaaaaaataaaatgcaactggttactagtgaaaggatgttaaataaataacaagtcattattttggaatttagcaaataaaggagataattatatacatatcctgcctttcctatacaaattgtacgactaggtaaacaaatagtagatatggagaaagttatctttatagcagtatttcaagtagtatgtgaagaaaaaaatgatagaatatctccattttgaaaaccctaaaaaaaaattaatgaaactagtcattgagcatcaacagctactaacaccaccaaaaatgaaaacaatacgatattatgtcctcctgagggaagacaattccacctaggaaaaagtctcctctcactccccaaggttgttctgaggattaagtgaggaattttagataaagctctaaggcacaaggctgggcacatcgcacaaaaaggctactttccttctttaaccacccttttccctggaaaccaaggcagtggttgtttctattactattgctgtttggaaagataatttatagtctaagaaaatatcccatattccttgggagaggccatggcagcaaccctccatcacagtgaaacaattatgtcatctttgacactgactctccatccactcagtctctccttcctctatccctttcagaggaacatagatctaatatcagtcacttatatgaagcacaattatgtctcaaagctagagctgaactggctgagatatacctgtttccaaggtcatgggtctcctccaaattcagtgctagtgcagagaactctttgggaatagcttcccagtctcctctctgttttgggaattaccactccttctccactaatatggttactgtataagggatcccagtacacatctgtacacacaatgaagacacagctcatagaatgtgaaatcgtgtccccctcaaaaaaatgcatggaagttccaacctgcaatatttgtgaatatgaacttacttggaattagaatctttgaagatataattaaggatcttgggatgagatcatcctaggtggatcttaacaccaacaattagtatatttaccagagaaagtacagggatactgtatttgagacacagagacacagagagaaggtgcccagggagaaaaggagaattggctgttatacagccacaagtcaaggaattctaagggttgctagcagccagcagaaggtactagagacacacagaacagattgtccaacagagccttcataaggaacaaaccctgctgacaactttgtggactcctggtctccagaattgtgaagcaataaatttttcttgtcttaagccaccaagtgtatggtcatttgttacagcagtcttagaaaactaacacacagcccctggcagagctcgctgatctagctccagatgctaccattggaaatctgtaattgtggccaagaaattccaatttcactctggctatctcttatacgtaagaaatgttaacccagccctgtaaactaggaagcagataaagtcattctacagcaaaagagaaaaatacttacagcttgtatcccattggtgtctgaggcccagatgcacacttattcttgggtcttatgagacatccctttatcaaaaaaccaaaaatcatccttttatgttcaaactagcacaagcggatttctgtaagtagtagcccaaagggtcctagtgcactcaggaaactgctgccaaaagtccttcaataaagatcaactggagcaattttttccttggtgggcatggtgccaggaaaagctgaatttactcaagaaccctttaagggaaatcaaaggaaactttaggacttagccacaaccacaataggcagagacgatgcgaaaaagtaacctcaattttcactgggcgtaacagccaaaacccagatctcatacaggttgaacattccttttccaaaaatccaaaatccaaaatgctccaaaatctgaaacttttggagtgccaatatgatgccacaagtggaaaattccacacctaacctcacgtgatgggtcacagtcaaaatgcattcaaaatttgtttcaggcacaaaattattgaaagtacgtatacaataaaaaatgaaaaatatagcatatatgatgtcatttaaagtattttgtgattattgattatttaggttgttatgaaatttacattggtaagaacacttatatgaataaaatatttgtgcataagtctcttgctaacatttctggccatttcttcagaccagattctgagaagttgagttactaactactaggtcattgaagcttatatctattggctctgtttgtgtacatatctaaaaactgagtttatatgttcaaacacttcatacacagatgaaatgtcaaacacaattatgtcaatatttctccaattaacacgacaaacctggtagttcatttagcacctagagtagtatttcaaaattcattttctttttaattataaagcaatgatgataataacaaacgactaatccattttcttttagctgttttgccgtcagcaatgggaagggcatgtgttaggtgatggacttggattggttcactcttttcatatgtatattataggactatgaagttagggagctaggctgtggctatgaaactgtctctctatatacttcaggtcagattccacaaacttcaccactctagctttcttcagagtcattcttaataatttattagtgtctatagtgtttgcagtactgagatgatgttaccataagaaatagcgtatgcggcatacaaacaggtcaataaccaacttgtttttcatatatgtcagaagcctatcttatgcagggacacagtttatctgccttcaaaaatccattttcaggggaatcctacaggctaaatcacaacatcattccagttaggcagagaaaataactttagctacaatctgtcttcttgcattccaagcacatacatgtttgcaatcaagtcctcccaaagattatacatatttctactctgtctgaggaaaagaaatgtgagatgctcttggtgtaattgctagatttagaatctaacttgcaattacacataaagaagcaatgggtttacaggtttgaaaatgtcgatattcaaaaaggttaattttgttttaaaattgcacctaatgatttttctggttataaaaataacatttattgcagaacatttagaaaagcatcaataaaaaattaaattacctctaatcctaaaacctagtgacaagtactgttaattattttatataatatttcagccatttttcattgcctctgtgtgtgtgtgtgtgtgtgtgtttaattgggcatatactgaatatactctttgacaactgttttatgcttattaatacatcacgaatattctacatatgttatatatattacataggcccttaattattcacaattatgttttctattggctgcattatattacattataacaatacatgaaacttatttaaccaataacatatttttggaattaggttgctctctattttctacaattataaataatactgcaagctagcattttgcatatctctacttccttaagataaatttctagaaatataattgtaaggtgaaaaggatataacctgttgaaaagattttgaaagatattcctatgttgccatttcaatatatattagattgccactcaaactatgtgtagtagtcagctgtagcagatggtattggcaccccactcataacctgtggcctacaccagagacagtttccatactcagcttcttatatgtctctgcccagggctttctcctgcctcagaattctgattaatccactggtgggaaaggcaaaaaatgtagagagggtaataccccaagaattactctcaacaattaaggggcaggaggatggatttcataaataccctagatttctacttctcacctctctgtgggacaactccgagttgtagtccacagtctcttgatggctccccagcaggactgagccccagttccccatagaaaactactcattagcattcccagtattgtctttattctcttccctgtcacagtttctcattccctcatagtacctcccggaatcactttccaaataaactacttgtatacaaatctctgtctcacagtctgcttttcatgaaatccaaactagaataacctcctgtttccttttacttcaggcttattttgaaactggaaaaagattaagataggattgataatacctgtagaatatatataaagacttaatcgcaaatttctagagaactatgtggcgatgaagatgggagaggctttaaagacaataggccaggcatggtggctcacatctgtaatcccagcattttgggaggccgaggagggcggatcatgaggtcaggagttcgagaccagcctggccaacatggcgaaaccccggctctactaaaaatacaaaaatcagccaggtgtggtggcgggcacctgtaatcccagctactcaggaggctgaggcaggagaattgcttgaacccaggaagtggaggttgcagtgagccgagatagctccactgcactccagcctggatgacagagcaagactctgtctcagaggaaaaaaaaatggaaagacaataaatagcataatttaaaaaataattctaattagcccaaacctgaacaaaaattgccctttattttcaatgcaaaaattgaattcaagtatttatatcataattctctattttttagaaaatagaaaatctaacgccttgactatctaggcaatattataagaagtatcagggccccttccttgcttggaagaggggttaagagagtccaattcaaaaagaaggtatcttgcttatgttcagcaaacagatgtctttatcatgtgagtaattcctaaatgactaatatgttgtgaattgaaatgaagaagtgcaggggaggaaggtcagaacaacgaaagatgctccttgactagatgtgataaggtagatagaaatgagtggcactgtttgttgtatgagaggaaagaacccaaagtagtccatcagattttgatcattagtgctgtcaaaaataactttctgtgttgatggaaatattctgcatctgtactgcccagtgtggtaaccacttgccatatgtggctatcgagcagttgaaatgtggttagtgggactcatgcaaccaaggaactaaccttttaattttgatgagtttaaacttaaataaccacatttggctagcagatactctattggataacacaaatcctggctctacactgactgcattatactacagttactttccaaaggtttaatctgggatgtgaacttcattatcctaaactactgaaaagaaagaaaaaatctttttatttttaaagttctggtctacaaagggctactttaaactctttcattgtgtgagtgggaaacaaacgagctaagatagggaatcaatcaaagagaagacaacaataataatatcaaatatttacatggtgctatgtatcagctactcttctacgcatttgatgtattttaactagtttaaacctattacaacctttgaagtatatgtcactattatttccattttacagttgatgaaactgaagtatggagagtttaggtgattctcccacagagctacgaaattgcaaagctgggaattaagctagagtctgggctctcaagcactagcccatacttgctcttaggatctcagaattattagacagactatttctggtcatccaacataaaaatcataccactaaaaaatcaatggtaaatcatatgtcttgttataagaaaaggaagtatttatgagtcttttctggtaaaaaaacaaaatctgggaaacactgggtactttggtattttaaatataccagttctacctaaaaatattctccagcatcaaatgtgaaagaagtctctttctttctgatcccaagtgatgtgttcctggatgaattataactatttttattactctagttgaaaaaacataactttgacatgaagttctctctctgatctctactctgttcatctatcacacactttttgtttgaactttgattggatgagtgcagaattagcaatggaaatccatgaagagattcacaaagaggaaaatcttacatttcttagtgggagagaatggtgacgtggtaggaaaaggatattccaatttaaaagaaaatataatgtcagaggtggaatactagatgaacagaattgaaacacatgtgtatcattttccattttactgttgaagaaattatggattttaatgtttgaatcctgacaatatttgtctaaactagattaagagagagaaaaagtgtaatgaactaagctatagatactcaggcaatcctactgattagctgtattgtcaagctggaggtgtgggtatgcagtgatgaggcacggaatggtttcacttgaaaatgttaattctgtgagaatcgttcaatttttgaaaaatttaaaacatgatatcctagagttttaagcagtcactgagcttcacactagcaagagaatatggatccatgccttgactttgatctccacaccaatctttccaagaataatgatggtacctgctctttggaatataacattagacttgctttcaagcctgagcatttgttgatcatgaaaagaaaaatcataggaccaccaatacactagattttcttcagtatcttagtgtttgagaatatttaccaacccataccaatttcattatttttttaaaaaagtatgactaaccaagttctagtttgttgataacgaaagattcttgacaagcagatgagataaggagaggaggagaaatagcataatgatatgactggactttagagtgtgagtttggggatatgtggctaaagttgatactggaagatgtaggctgaggccacatcatggaagtcgttgaggtccatatttaaaggttttcatctttaccctgaagatggagaaaacacatcaaaaggtgtaaacaggattaagtttattcagattcacagttgagaatatatttctggtagaattgtgaagagtaaatttggagagcttgcagatctgattcagggaaatgaattttaagagttttgcaaatgagatttgtttaaatacagtgttcggctattaaactactaaaattgaaagcccctgtctcaaatgaatatatttgggtccaggtgatacacttgagcataatttctaaataactgttaccatcaaactcatttttgaaatgcaagaatcaattcttttaagtcaattaaatatacaaaatattggtctaatataattgttaagttagataacagatacctttagaaaaaacttaaaaggtctcaaatataagaggtattttacctagattatctgtgtttactgtatttactgtgaaaacaaaaattctgcccaagtatacaagacactaagaaaaccttggcattaaaaggacctgccacttcctctcagcctcctcatttactgtaacgtaaggaatttctgtacaaagctgccagctgccatgaacaaagattaagaaggtgatttacaggagttaatagaagataaactctgcattagatgaagataattgtaaaaaggttctaggaacagtgtatgactgatcaaaatggattttaaaaactttaaaagaaatatcactatattgacaggcaagttaatatatattcatgtatgtcagcgagaaagtaggacaagagaaaaaggaacttggtcagtcacgggaggtggtctggtggaggagatttggcacaaagagtgagcaataaataggaggggaagactttttaaaaatacattattcaacttacaggatgctttatttttgtcaaattgagggcaggccataacccttcccacctactacagcccagatgagaacatgtaaagaactgaaaaagagaacaagcagcagacaagaaatatagagaggaaagagcccttcctggggtaacaaacaatagatgtaccgtcaaggacacaatggaagatccagcagtggatgaaggatccgtggattaggaaattcagagcagcagtagctggagctacagaaaatcagtggaagatgtatgttaaacaataagctttgagaacaaattagatttggatattgagaagttttgcagttagtacaaacacctgataaaaggaagtagcaatctgatgcagaccagtatggataccagaatggcaaagagaagagaatcggtacagcactagatcgaagacatttcccttcaactacttcattaaggattttaccaagagcttggtgggattgatttaaagggaataccagaaccaaaaggtatgctgtctgtggtttgtattatattttaatataatcatatggttatattcattagacatacacacatgcatacatacacacactatttaagtcactgtttcatggactgtctcattctcattccatattatggacattctcatttttaattaaccctctctgttgtctttacctggtcctgcaccaaaagaatatgactaagggttgttcaaggcagatattcaaactaaattccttcattaattgttaccttcaatatgctattgtccaaagaggacatacaagttgcacagtaaacttttagttcattgacgtttctcaagtgtctgtcacatggtaggttctaaagataagttctcaattaatgaatgaaactgttaatgaatggtattttaataaaccttatacttggctgatcatgccacatctgttatttacgcatgtttcactacaaccagccctagggggagttacagagattattttattcttcatttaaatgcaattcattattttttatcttcttaaaataacggacatgcaagtattcaactcttagacgtcatatgaacgttactgcaatgtctaatctgaacttacgccattatgctctttgacctggaaagtgtattttcctctgtttatcataagacattgcaagggtcaagaccattgaaatcttcagcatgaatttttcatcagggatgtaggatcttcctggggcagtataaagcaagagtgtgaaatggcttccaaagagataatgatactttaaattctattaataaacatggtgtctgtatcaacattgtctccacttctgaataacacactttaaatgggaaaatggcaaaatggaattttcaggaaaaatgcaaccagactgtcaaggtgattttagatattgtcatacatggaaaacttggagtaactcatgatttgactccctccccctcaaaaatgttttatcagttatccaaatttccatgaatgacaccactattcacccaaatgtcaaaaagcctaagagtctttcaggatctctttcctttcttcacctctctgaattaaatacaaatactattaccaattgtaatattaatgctaatgcaattattgctaatagtagctaaaattcaccaagtatttatgttctgtcagactctatcctaggagcttcacattctctcaatctccataacaattttaccttccatctttgatgaatttgagacttagagctattaatgtagttgcacatagtcataaaaatggtaaagtcaggatttacacccaagtttgttagatttcacaacctgactcaagtcccgtcatgtctgtctctaaaaatgtcttatctctgaccacttcttctcttctatgatactactaatctcattaaaaccagcatcatctcttacctagactattccagtagtctcctaattgaagttaggtgtttatatatattatatgaactaagcctgtctacaggtccatgagataaatatcgtatcacgcaaaggtgaagaaatttagaccagagaggttgagatgcccaaagtaacacagctaataaataaaggaggatcagatttgttatataatactcaatgacttaaatttagtttgaagaagttcaactggataaggagagtggaatgaaactaaatcaaaagtattcccctctaacattaataaaattaatgaaaataataacagcagcagaagataatacttattatttgcaatcaaacatataacagaacatgactcaaagaactaaacttcaaaaactgatgccctaaggaaaaaggcagtaactgtcagagaggtgctgaaagtttcctgactatagacctaatcatgagccagactgatgaattggcaaaatcataggaactctaacaatatccataatttaggatagaaaaaagcttagtcaatgtttctatcttattcctcttctgacttgggataagtggtgaaatgcagaaaatgtaaaataaaatgaaaaattctttctaagagaactaaaggctctactatctacacaattggggaaatgatttaaagccagactatatccctccatagaaacaggacacatcctgactggagagaattaaccctgactcaagaaatttaaggttttctcaagaaacagaaacaaaccacatgttctaacagagcctgcaaaaagccccagtggaattttcctgccatcctggataccacacactttcaatacctagtcccaaaacttatgctcagatgttatgaaaaaagtcgaggatagtcaggcaaagagaaaatagaagtgttcactgcatgctaacatatgggcaagataaattaaaaacacacaaaaattccagatatgtaaacatattacaacaataccaaaaaagaaagaccaaaaaaagtaacgacagatgaaaaatccactcttaaagaaaacataagacaataaaacagaaagaaaatccccacaagtattttacattataaaacaacttaataaggacctggattcatgaaagcaaaaacataaacttaagatcataaaaagtagaattatatgaaaatagagatagcagatctaaggaactaaattaaaaaccaagagaacataatttcataattaatagaaatcagaaataccaaaaaaaattaaagaaagatggataaaagttgaattaccaacatccaccacgaagggatatgttgagataatcatggagaaaaaaattaagtattgaaattatacagctcttttaaaaatgaatgggaaaacttggaagcaaccaagatgaccttcagtaggtgaaaggataattaaactacgacaatccagataatggcatattattaagctctaaaaagaaatgagctatcaagccatgcaaagaaatggaggaaactgaaatgcatattatggagtgaaagaagccaatctgaaaaggctgtgtagtgtatgattcccgctatatgacatcacagaaaggcaaaactgtggagacagtaaaaagatcagtgatttctaggagttagggaagagggagggatgaataagcagggcacaggatttttagggcagtgaaattattctgtataatattacagtgatgcatacatgtcattacacatttgtcaaaatcaatataatgtacaacaccaagagtgaacactaatggactttgaaagataatgatgtgccaaagtggggttcatcagttatatataccactctgatgagggatgttgatagtgggggaggctctatgtattgggaggagaggggtttacaggtactctctgtactctttgcccaattttgcaattaacctaaaactagcctaaaatagaatctatttttaaaaatacaataaaactcaacaaatggggtagatatgattatttgttaatataataaaatttctcttaattatagaaacaattgaatctgtagattgaaggggtaataaatgctctaggaaaataccagatgatcttaccctgtatcttagtccattttctgttgctgtaacagaatacctaaaactgggtaatttataaagaaaataggtttatatggctcatgattctggaggctgggaagtccaagaagcattgtgccagaatttgcttgacttctggtgagggcctcttgcaatgtcaaaacatggcaaagaaacagacggagaattgtgtgcacacaaagagggcaaaacatgagaggcaatttcacttcataacaacttgtccttgtgggaatgaatccattcccctgagagggagaacgaactcattctcaagagtgacctttcatgacccaaatgcctcttaaaggtctcatcagttctcaacacggttacattggagaccaagctcaatatgagatgtggcgaggacaaaccatattcaaagcatagcaccctagtaaaattattgaacttcaactataaataaagaattccccccaaatatccatcaaaagcaagtcatctacagggaagaaaacaagctattctcagatttctccacaacagtctttaatgccaaaaaacaatgaggacaatagctacatatttctagtgaatgaaattatatcccgagaacattataataagttatgatgttttaaaaatatatagggaacaaaccttaattttcaaataggaaagatctagggaaaacagtattataagcccttcttgaaagaactagttgacaacaaaatccagataattaagagattaatcagaacaaagtactcagtaatggccatggcaaaagcccaggtgatgagcattaaatttaggtaagtatagaataacactgagtatatgccaaaattaatggcacagaacaaaatcgaattgttattataagccccaactatataaaaagtaaaaatttaactaaaaacaaattagaaaggaggggtgaggtgggaagaaatgtaatagagcaaatgatcttgtttttgcatgctgtaaattcaatcaatcctgcctaaaatttagccacatagttaaatgaaaaatcacagctccaacctcttaatagtattcaaaattcatttaaattgggagagggttcaatgagagtcagataccaccaaaaatgttttcagtctacaaaatcacaatctagtaaattgagagttaagaatagcttaagaaaaaaagaaagggctacctataaaaaagaaaattcaaaatttatatcaacaccactccaaataaataaccacaataatattttcttcatcagtttatttagtcccaggtaattaattgttctgttgaccagcactctgctttcatgaaacatgtttgctttcagactgaaaagattcctaaaattcctaacagtccatagtacagcctgacagcttaaccagctgtcatagtacagcctgacagcttaaccagctacagatcttagctaaaagtctatttcctaaagtatcaatagttcatggtacattggaaagtcattccctcaagattctgagactattttctttttttgtttgtttttgttgtttgttgtttgtttgtttgttttgagacagaatctttctctgtcacccaggctggagcgcaatggcatgatctccgctcactgcaacctctgcctcctgggttcaagtgattctcctacctcagcctcccaaatagctgggattacagacacgcgccaccacgccggctaatttttgtatttttgatagaaacagggtttcaccgtgttggccaggctcgtctcaaactcctgacctcaagtgatccacccgcttcagccttccaaaatgctgggattacaggcgtgagccaccgcagccggccctgagactgttttcttcacaaattttaacctgtagcttatagcagagccttcagcaagcatcaagtggaaggataaaactgataatacaactggatggttgtggttaatttatcacagtcaccgtagccagtagtatacagacacagaaaggtagatttctctattggaaatagagaaataactatttctgaagggtttgatcaatgagtcccttaaaaataataatatattatgaactgtgaaagcactgacaaacctccagggccttgccataaagtttacaatctctaaaatatttatatcaataaaaatttacctatacaaacttaagaaggttgagaatctcttctgatctgataattctttccatgaaaattttacaatagtgttgagtaattaagaaatatgtcaaaaaacaccttaattatttctggcatccctttctgatatggtaaaatagctttttttttttttttttttttttttttttgcttttctagggactttttgggaaatctcatagacaatttcagatattaaagataatctaaaatttttatttatattttaatgtaggatttgctcttgaaaggcataattaaaagagatttcagaaagatttggtcagtttattaatacagaatcatgaatgcttaagaaataatgcctattaatgaaagagtcaaaagaaaataaaatagacatagagaaaagtagcatgattataaagaaccatagctctttcacaagtgaggaacatttttttgttgttgtttagaaaaatcataattgtttccatagtcacaaaccattcctctgattccagcaatgtgccttgaatggtcttgcgaattacatggggtaagacagttctcactgataggggactatactgtaagccagccagccagccttcctgcctgtccgtttttcttttccttttttccttccttccttccttccttccttccttccttccttcctccctccctccctccccctcttttctcccctttattcatttatttctctttctcttagaagtgctattttgcacacacacacaaaaatagaaattgaaaatataatcaaatcaacaaaagcagagaattcaattatggtgagatatggaaactgctatctgggcagattaccaggaaggaaaggaatacatacatcttcttaccccttgtagaagctctaagacaaatttatcatttttacagagagaaatctaagctctagtttcaattaatatgttatttgattattaaaccaattaaaactgagccaactttgtcaaaatagaaacacattttgttgcttcttttcagactcagcatttgaaactattacaaacaaagacaatttaaaaatccctttttacaaactttttcaactttctatatacattctacatcaattaaggataataacacttttcttcttgcagaacaaaacctcactcatttacaactgcaaataaggggttgcatttctctgtcagtattgctccttgtatagtctgaaccacatataaacaaagtgactaatttgtgtttttacaggaaaatttaaaaaggggtcatatatttgaaaactatctgtcatatacaagcattctggcagagtagcaaagctcataaatacaaataacacaactttttgtagccactcaaaccccttttacacttagttaaaatgacaaaaaggaacaccttttttaccatgactcatagataaggctactctacaacatattagaaggaaacatatctgaataaaagtatataaacttagtaatcaatgctacagtatccaatcattcttaagaattatattggtgtttaataattatccataaattaactcaatttaagattagtccaggattttaaattaactaaggatgtataaaattttatttaagctactaaaatacataacataattgctgttagtataaagtttgttagaacagagaatcaatttagctgatcacaaatttatatttttaataattttaaatatatagaaaaaacgtgagcttatttgattattaaaccaatattagaagtttcgaaagtttaaaataactattctgttcatgaggtatggtaaatcaaaatcttattaaaaatataaaatgtgcacttgtcctatgcctccttctgataaattcaaagaaatgatataaattatcatttattttaaaccaaaattactaatttaggctaatgtgtcaaaatactaatctttatcatataaacttggatttcaaaaacatttctaagctagtagtttttaaaatactagaatttcaatttctttatttcctgtgaattttgggaatatcctatttacataagcacatatccttaaaaccaatcagaacagagcttctttaagacatgtaataatgtaatacgttaaaaccctctgtaagtagaaaaatatttcacactcacataatgaaaggtaaaggcctttctcaagaacagagacacagagatacatgaagagcttatagctatagttctacaaccttagctgcaggtcaaaaataaacatagaatcacaaaatctcactggtgcaaatctcaaagggattttctccttctcagatggcaaggaattcttaactgatttgagcttacaagtagacaaacagacaaacaaacaataaagaccaacacttcagattttctgttgtctttcatccaacaacatagatatgtaccatccttccaacagcgattgccacatgggtcaggtggtataaagaaaatctcaactattactgccaccaatggagaataactttttggccatacattcaccagaaataaaaacacaaaatcaataggaaaaacaaaaataagacaaaaacaaaaatagaaaataaacaaggtttaagttacattgttgcttcagatttattctgagagccaagcaaacatctaactgggctgaaactgtccctgaggtgcacttccccggcattgcaatttacttggctccatcaggtgcggccatgtggatatttaagtagatgacctccaaaactgtaaaagtataattttccaaaagaccaagtcagagctctcatgcatacataaaataaatatgtgtcacatatttcataaaactcattaattaattagggaaacactaagattataaaaaaaaagtccaaaaacatttgagaatttaggtattaataggcagtgttacagtgagatttctgaattagacacaaaactggtcaacgacctacatgaccataaactggaacttctggggtagggttgccagataaaatataggacactcagttaaatgtaaatttcagatgaacaatgttgttttcttttttaagtacaagtatgtcccaaatactgcaggcactttttagttgctaagtctggcaactctacaatgggattatctgttctatggaacagaaatgatttgcatttcttctggacaaaaatttacaaattaaactctgcccctccagaaatgttaaatatgttaaatagcccagacaatagaaagtcaagcacagaactgcactgaaagaactgctagtaatctttcttacctatttccaaatttttgataacttttccagtgaataaagaatagctggctgggtgaggtggctaatgcctgtaaatccccgaacttttggaggccgaggcaggtggatcacaaggtcaggtgtttaagaccagcctggccaacatggtgaaaccccgtctctactaaaaatacaaaaaaataagccaggcatggtggtggacacctgtaatcccagctacttggaggctgaggcagagaatcgcttgaacccgggaggcggaggttgcagtgagccgagatcacggcactacactccatcctggatgtcagagtgagactctgtctcaaaaaaaaagcctagagtggaaaatattatttattacaaagtaacattggagattaagatataaacaacaaccataaatattatttccttaattctctttatattcaatttgagaaagcattagtcatttttcccagagtactatttgcattcaggaggtattctgatatttgagactgcatatcatagtcataaacgcagaatggaaaggttatttttagccttctggctttctcaattgcagaacaatattttcttccagaaaagaaaacataaaagacctcacaatcagataacaaggcaaaaattgttcacgagtattactttaacaaggtctgtagctctatcctcctgctgtgttcatctctgaagcaaagatagccattctacacttctaaactatgagtctagccctcaaggaattttcctagccagcaggaaactatataagaactatataaatttgattttaaaggaaaagctaatgagtaaatgatgttagttgcaaaatttcagcaaagaagaaatctactcaatagctagacagacaataatgtccacatgatatctatataaaatgatccctccaatgcaatcgggctattttgaggtattcattcattcttcaaagatttattgagctctacgtatgtgttagacttggtgataccaatacaaacaacaaacaaattggattcttacccttatgagcttatgtctagtctgtttgtatgaaaagagggagagaacaaacaagagaaaaactactatatagaagcttagtaaccaaactttaagaaactctacaaacgaatttttgaactcaaggtttaaatttgttctttgaaatactgacagtttaatgaaagaccaatcttagcttgacaaggaaattatgatttttgtttgttggtttaaacttttgcaatttaggaagcaatgtcaaaaacaacaactcagtcaaaatgccattttggagagacagagaatgaaaatctgaatttaaaaagagaagtacaattgtagtattagaaaggtaccaacatatctatttataattataaaagtaatggttagtactgaatggtcttgtaaaataggcagatcataaggtaagagtaagctctgttcagacaccattattcaagcaataatcaatttggcaacacgggaacttaccggaatcaactggggaaaattttcaaactacacagaaataccccatccttcagatttgaatattcttttggtggttgtaatcaccagttgcctatccagaacagattctcccctaatgaaaacacggatttattgagagcactctgtgtccattagtgctcacctctccagacaactgaacttgactctgtgaccccatctaactaattagataaaagtgaaaatctactgcatggccagagatttctgtagaatatcatggatggtgaactaggctgtgatatagctacggatcagtggataacaaaggaccagaacaagagtagaagaaaattgtagatttctggaaaatctacagttttcctgaaaaacaaaaaaaaaagagagacaaatttagtttgctctttaccactgtccccttcttcctgcctgaaatggggaatcatagctaaaggcaatgccaacgtctttccatcatgaggaaccaaactttaagactggaggattagaaagcaaataggagcctgagccacaattactttgttgagcagctacactttgcttgggctgcttatctcttaacttctggatcagcgaggaaaaaataggtaaactattaaggcaagtcatgtaatttggtttctctcacatgcagcaatatccaatcctaacagtgtaacagaagtggagggaaaagaggaagggggaaggtgaatatttacattttaaacttgctcctgggaaattctaatgtgaacctcttttgttttataaggaggaactgttcacgtactccatgacatctagactagggttttgcaaactttaatgtgtatacaaatcagccaaggttcctgttaaaatgcagactctccaattccattggtatggagtggggcctaggattctgacattttagcaagcttccatgtgatgctaatcattctactctttgcaccaaactctgagtagcaaggagttagacacaaaactgaacaataatcttaactggcattgtacacagtgaccattcagttcagatggctctccttaactgtatctgaaagatttgttttaacccagagccttataatgaaaaacataatggaacctaccatatggaaataattatacatattttactgaacattaaacattctctctccctctgactctctctattctacctatacacacataagcattactaaggtataattttttaaaattataattataatttgtatgtcaaagattttattcaaaaacgaattaatgaaggtaacagcaaaatgttaagactgattcaaagaacatttgagaagatagctattggttgaaaattcaataaagaatgttagcagaagattgttgggttaaatacaaaaccgataattgtctacagggcaataaactctaagctgcggagttatcttttctgtgggataacttatttgcatctctactggataaaaattttccacttaacatgtaacctcacaaatagccttgatagcatattcgtatgtaagataaacacatatataagatataataattaccaaatgttgctgtggtataaatgctattaactccaatccagacttgctggggggcaagaaaatggcttagctacaagtaattggaggaaatgttatatccagatttgcttctactcttgttctggtcctttgttatccactgatcttagctatatcacagcctagttcaccatccatgatattctacagaaagcagttctctttagttgcttcagagaaaactccatggacatctcagttgtactgtgagtaactactcaaagggaaggctatagagcagaaactacgccccttgtattttaaatagctctgtagctcaaatgctaattattacttagcaaacacataaaaattctggtataagagatacatctcttccaatacacagactgtaaaacaggctattgcagttacattttatgcatagatagataactttttctctcagcagttggggcaaaagtagaagagcctaccctgccttttggaggaagaaaataattattttattttattttattttattttatcttttgagacggcgttttcgtcttgttgcccaggctggagtgcaatggcacgatctcagctcactgcaacctctgccttccgggttcaagcgattctcctgcctcaacctcttgagtagctgggattacaggtgtgtgccaccacaccaggctaatttttgtattttcagtagagacgggatttcaccacgttggtcaggctggtcttgaactcctgacctcaggtgatccacctgccttgacttcccaaagtgctgggattagagacatgagccactgtgcccagccaagaaaataattttttaagagagtactgcctcaaaacttttccacaaattgcttaaaatatcatagcccacaactgagttccagctatggctgagtgaggaggttggcaaattctcttcccaaaaagaaactatgaagctgaacagaaccgataaaaacaaccatctgagcactatggtatagattaaagacatacaacaatgtaagaaatatttatgcttaaaaaattctgaatttttaaaaagaagagtaggaatctgtgacatttttgcctggggtgcctggggctgctcccaacacctcccagctctattctcatggtggttctgccagagcagggcaggccatgaggactgagagcttcactgatatggtcattctctgcagcctgtttgcacagtggcagaatatacatttgttccaagcatacagggaacatttagaaagatagaccatattttaggccataagataagtctcaataacagtaaactgatttaagtcacattaaatatattctctgaccacaatggaattaaattagaaatcaataacaaaatgatctctgtaaaatccacaaatctctgaaaactgtcatacttctaaataacccaaagatctaagaggtcaaacaaaagtaaaattacaagcctttataacttaatgtaaattaaaacacaatatgttaaaacacatagggtacctctacagaggcattaaaggacaaaatgccaatattagaaaagaaaaaagttctcgaataaattactgcaagttttatcttaagacactagaaaaaagaagtgtaaattaagcccaaagcaaatagaagaaatcaaatagtaaagatcagagtagaaatcagtaaaatgaaaacataaacaataaagaaaaatcaatgaaaccaaaaactggtttttggaaagtttttttaagtattgtataaatttaaggggtacaagtgcagttttgttacatacatatgttgtgtagcgttgaattgtggtcttttagtgtaactatcacctaattagtgtacattgtacctattaagtatttatcatcccttactagcttcccaaaagtgataaacttttagccaagctagccaagaaaaaaaatacacaaattatgaatatcaagcatggaagaagtagcaccattagagattctagaaaatataaaaggatgatggactattatgagcaatttatgtcaaaaaatttgaaaactttgataaaatgggcaaattactggaaagcatgtacaacaagagctcactaaagaaaaaacagataatctgaataatcctatatatattaaagaaattgaaatttgtagttaaaaacctttccacaaagagaactccaggatcagatggcttcttgtgaattctaccaaatagttaaggaaagaataataccaattctacacaaactgttcagaattgaagtggagagaatacctcaactcacttactaagaccaacattatattattaacaaaaccagccagaaaactgataagaaaagaaaactatggaccaatgctatggtttaaatgtgtccccaaagtccgtgtattggaaacttaatccctaataacgtgatgtagagagggtgaaactttaagaagtgaataggtcataaaggttctgccttcatgaatggaataatgccattattgagggtgggttcattattgcaggaatggattctttgtaaaaatgagtaggtccctttcttcctctctcaccatgtaataccttccatcatgttatgacacagcacgaaggccctcaccagatgcaggccccttgatcttgggctgtccagactccagaacaatgaaccagataaatttctgttcattataaattacccagtctgtagtatttagttatagcagttatagcatatgagcctccacttccagcctacaacaggcttatttgtaataaccaaaagctagaaagagatacaaatgtccatcaacagttgaatagaataaaagcaaaaatatctgtggtacagtcatacaatgggattacttctcagcaataaaaaaggaattgctatggtctgaatgttagtgttcccctaaattcatgtgttgaaatcctgacctccaaggtgatggtattagaaggtagagcctttgagggtgattagttcatgaaggtggatccctcatgaatggggttactgcctttctaaaagagaccccagtgagctatctagccccttccatcatgtgaggacacactgaaaagtcatctcatatcaaccagaaagtgggttatcatcaggcattaaatctaccagcaccttgatcttggactttccaacctccagaactataagaaacaaatctatactgtttttaaactacccagtttatggtattttgttatagaagcccaaatagaacaatacagaaatgaaccattgatgcatgctacaatatggaagaatctcatagtaaatatgccgagtgaaataaatcagaccaaaaagagtacataggcaggagagctggcaagatggccgaataggaacagctctggtctgcagctcccagcgagatgaacagagaaggcaggtgatttctacatttccaactgaggtacccagctcatctcattgggacttggttagacagtcagggcagcccacagagggtgagctgaagcagggtgaggtgtcacctcacctgggaagcacaaagggtcagggaactccctcccctagccaagggaaggtgtgagggactgtgccgggaggaacggtgcattccagcccagatactacactcttcccatggtattcacaacctgcagaccaggagattccctcaggtgcctacaccaccagggacctgggtttcaagtacaaaactgggtggccatttgggcagacactgagctagctgcaggagttttttttcataccccagtggcgcctggaatgccagcaagacaaaaccattcactacactggaaagggcacagcagccagggagccaagtggtctagctcagcagatcccacccccatggagcccagcaaggtaagatccactggcttgaaattctcactgccagcatagcagtctgaagtccacctgggacgcttgaggttggtagggggaggggcgtctgccattactgaggcttgaataggcggttttcccctcacagtgtaaacaaagccacagggaagttcaaactgggtggagccaacggcagctcagcaaagccactgtagccagactgtctctctagattcctcctctctgggcagggcatttctgaaagaaaggcagcagccccagtcaggggcttatagataaaactcccatctccctgggacagagcacctgggggaaggggtggctgtgggtgcagcttcagcagacttaaacgttcctgcctgccagctctgaagagagcagctgatctcccagcacagtgcttgagctctgctaaggcacagactgcctcctcaagtgagtccccgacccccatgcctcctcatgggagacatctcccagcagaggtcgacagacatctcatacgagacagctctggctggcatctggcaggtgcccctctgggacaaagcttccagaagaagcaacaggcagcaatctttgctgctctgcatcctcagctggtgatacccaggcaaacagggtctggagtggacctccagcaaactccagcagacgtgcagcaaaggggcctgactgttagaaggaaaactaacaaagagaaaggaatggcacgtccactcaaagactccatccgaaggtcaccaacatcaaagaccaaagacagctaaatccacgaagatggggagaaaccagcgcataaaggctgaaaattgcaaaaaccagaactcctcttctcctccaaaggatcacaattcctcgccagcaagggaacaaaagtggacgaagaatgagtttgacaaattgacagaagtaggcttcagaaggtgggtaataacaaactcctccaagctaaaggagcatgttctaacccaatgcaaggaagctaagaaccttgaaaaaaggttagacgacttgctatctggaacaaccagtttaaagaagaacataaatgacctgatggagctgaaaaacacagcacgagaacttcgtgaaccatacacaagtatcaatagccaaatcgatcaagcagaaaaaaggataacagagattgaagatcaacataatgaaataaagggtgaagacaagattagagaaaaaagaatgaaaaggaatgaacaaagccttcaagaaatatgggactatgtggaaagaccaaatctacatttgactagtgtacctgaaagtgatggggagaatggaaccaagtcggaaaacactctgcaggatattatccaggagaactttcacaacctaccaacacagaccaacattcaaattcaggaaatacagagaaaaccacaaagatactccttgagaagagcaaccccaagacacataaacgtcagattcaccaaggttgaaatgaaagaaaaaatgttaagggcagccagagaggaaggtcgggttacccacaaaggtaagcccatcagactaacagtggatctctctgcggaaatcctacaagccagcagagtggaggccaatattcaacattaaacaaaaaaattttcaacccagaatttcatatccagccaaactaagcttcataagcgaagaagaaataaaatcctttacagacaaggaaatgctgagagattttgtcgccaccaagcctgccttacaagagctcctgaaggaagcactaaatatggaaaggaaaaaccagtacaggccactgcaaaaacataccaaattgtaaagaccatcgacactatgaagaaactgcatcaactaacaggcaaaatgaccagctagcattgtaatgacaggatcaaattcacacataacaatattaaccttaagtgtaaaggggctaaatgccccaattaaaagacacagactggcaaattggataaagagtcaagacctataggtgtactgtattcaggagagccatctcacgtgcaaagacacacatgggctcaaaataaagggacggaggaatatttaccaagcaaatggaaagcaaaaaaacaaacaaacaaacaaacaaaaacaaaaacaacaggggttgcaatcctagtctctgagaaaacaggctttaaaccaacaaagaccaaaaaagacaaagaagggcattacataatggtaaagggatcaacgcaacaagaagagctaactatcccaaatatatatgcacccaatacaggagcagccagagtcatacagcaagttcttagagacctacaaagagacttagactcccacacaataatagtgggagactttaacatcccactgtcaatattacatcaacaagacagaaaattaacaaggatattcaggacatcaactcagctctggactaagaggacctaataggcatctacagaactctccaccccaaatcaacagaatatacattcttctcatcaccacaatgcaattattccaaaattaaccacataattggaagtaaaacactcctcagcaaatgcaaaagaatggaaatcctaacagtctctcagaccacagtgcaatcaaattagaactcaggattaagaaactcactcaaaaccgcacaactacatggaaactaaacaacctgctcctgaatgactaccaggtaaaaaacaaaattaaggcagaaataaagaagttctttgaaaccaatgagaacaaagacacaacttaccagaatctctgggacacagctaaagcaatgtttagagggaaatttatagcactaaatgcccacagcagaaagcgagaaagatctaaaatcggcaccctaatgtcacaattaaaagaactagagaagcaagagcaaacaaattcaaaacttatcagaagacaagaaataactaagatcagagcagaactgaaagaaatagagacacgaaaaacccttcaaaaaaatcaatgaatccaggagctggcttcttgaaaaggttaacaaaatagatagaccactagctacactaataaagaagaaaagagagaagagtcaaatagacacaatagaaaatgataaaggggttattaccactgatcccacagaaatacaaactaccatcagacaatactataaacacctctatgcaaataaactagaaaatctagaagaaatggataaattcctggacacatacaccctcccaagactaaaccaggaagaagtcgaatccctgaatagaccattaacaagttctgaaattgaggcagcaattaatagactaccaaccaaaaaaagcccaggaccagacggattcacagccgaattctaccagaggtacaaagaggagctggtacccttccttctgaaactattccgatcaacagaaaaagacagaatctgccctaactcattttatgaggccagcatcatcctgataccaaaacctggcagagacataacaacaacaaaaaatgttcaggccaatatccctgatgaacatagatgcgaaaatcaacaataaaatactggcaaaccgaatccagcagcacatcaaaaagcttatccaccacgatcgagtcggcttcatccctgggatgcaaggctggttcaacatatgcaaatcaataaacgtaatccatcatataaacagaaccaatgacaaaaaacacatgattatctcaacagatgcagaaaaggccttcaataaaattcaacaccccttcatgctaaaaactctcaaaaaactaggtattgatggaaagtatctcacaataataagagctatttatgacaaacccacagccaatatcatactgcacaggcaaaagctggaagcattccctttgaaaatcagcacaagacaaggatgccctctctcaccacgcctattcaacatagtattggaagttctggccagggcaatcaggcaagagaaagaaataaaggtattcaaataggaagagaggaagtcaaattgtccctgtttgctgtgacatgattgtatatttagaaaaccccatcgcctcagcccaaaatctccttaaacatatacgcaacttcagcaaagtctcaggacacaaaatcaatgtgcaaaaatcacaaccattcctatacaccaataatagacaaacagagagctaaatcatgagtgaattctcattcacaattgctacaaagagaagaaaatacctaggaatccaacttacaagggatgtggaggccctcttcaaggagaactacaaaccactactcaaggaaataagagaggacacaaacaaatggaaaaacattccatgctcatggataggaagaatcattatcatgaaaatggccacatagattcaatgctatccccaccaagctaccattgactttcttcacaaaattagaaaaaactactttaaagttcatatggaaccaaaaaagggcccacatagcaaagacaatcttaagcaagaagaacaagctggaggcatcatgctgcctgacttcaaactatactacaaggctacagtaaacaaaacagcatggtactggtactaaaacagatacattgaccaatggaaaagaacagaggcctcagaagtaatgccacacatctacaaccatctgatctttgacaaacctgacaaaaacaagcaatggggaaaggattccctatttaataaatggtgttgggaaaactggctagccacatgcagaaaactgaaactagatgccttccttacaccttatacaaaaattaactcaagacggattaaagacttaaacctaagacctaaaaccataaaaaccctagaagaaaacctaggtaataccattggacataaaatccctagtaaaacctaggacacaggcatgggcaaagacttcatgactaaaacactaaaagcaatggcaacaaaagccaaaattgacaaatgggatctaattaaactaaagagcttcagtgcagcaaaagaaactatcatcagagtgaacaggcaacctacagaatgggagaaaatttttcaaatctatccatctgacaaagaactaatatccagaatcaacaaggaacttaaacaaatttactagaaaaaaacaaacgaccccatcaaaaagtgggcgaaggatacgaacagacacttctcaaaagaagacatttatgtggccaacaaacatatgaaaaaaagctcatcatcactggtcattagagaaatgcaaatcaaaaccacaatgagataccatctcacgccagttagaatggaaatcgttaaaaagtcgggaaacaacagatgctggagaggatgtggagaaacaggaacgcttttacactgttggtgggagtgtaaattagttcaaccattgtggaagacagtgtggcgattcctcaaggatctagaacccgaaatgccatttgatctagcaatccaattactgggtatataccccaaagattataaaccattctactataaagacacatgcacatgcatgtttattgcagcactgttcacaatagcaaagacttggaaccaacccaaatgcccttcgatgatagactggataaagaaaatgtggcacatatacaccatggaatactctgcagtcataaaaaaggatgagttcatgtcctttgcagggacatggatgaagctggaaaccatcattctcagcaaactaacacaggaacagaaaaccaaacaccacatgttctcactcacaagtgggagttgacctatgagaacacatggacacaggtaggagaacatcacgcactgggcctgttgtggcagtagggggctggggagggatagcattaggagaaatacctaatgtagatgacgggttgatgggtgtagcaaaccaccagggcacgtgtatacctatataacgaacctgcatgttctgcacatgtatccaagaacttaaagtataattaaaaaaaagagtacataatgtattactcaatgtatatgaaattcaagaaattagaaactaatctatagtgacagagtatatcagtgttttcggagggacctgaggtgaggaaggggcaaaagggaggcattagaaaaagttcggaagtgatgtacgtgtttattttttttattatggtgatggttttattggtgtatacatgtgacaaaactcattaagttgtcggacttaaatatgtactgtttattgtagcaaaataaagctgtttaaaaaaaacgtcaagtcccacaaagaaaatgtcaggttcatggaaccaaatcaaatgcccatcaatgatagactggataaagaaaatgtggcatacatacaccatggaatactatgcagccataaaaaggaatgagatcatgtcctttgcagggacatggatgaagctggaagccatcatcctcagcaaactaacacaagagcagaaaaccaaacaccccatgttctcactcataagtgggagttgaacattgagaacacatggacacagagaggggaacaacacataccagggcctgttgcagggtgggggtgaggggaggaacctagaggacgggtcaataggtgcagcaaaccactatggcacaagtagacctatataacaaacttgcacattctgcacatgtatcacgtttttgtttttgtttttagaggaaataaagaaaaaaaaagtcaggttcaaatggttacactggtgaattttatcaaattttttaaaaatataaaaaatttttacaaactttttcagtaaatactggaggagggaacacattttccaaagccttctatgaggctagtattactctaatataaaaactagacagacattataaagaaacctacagaccagtatccctcattaacgtagacacaaaaaatattctttaaaaaaattaacaaatcaaatccagcaacatagaaaaggattatacaccataaaaaattgaaatttattaaaagaatgaaagggtaatttgacataagaaattaagtcaatataatatcatattaataaaggacaaaaacacatactcatctgaaaagatacaggaatttaacaaaatacaacactcaatcatgttaagaacactcaaaaatcaaggaatagacgggaacttcctgttcttcctcagatcaggaacaagacaaggatgtctacttttgccatttctattcaacatagtactggaagttttagcagagcaaatggggaagcaaaagaaatacaatttatgtctaattgcagatatcatgattttatatataaaaatcctaagaattttttttaaaaaaacctattagagctaatgaaaaaattcagcaatgtttctggatacaagatgaatatacaaaaatcaattgtattcctatatactaacaaaaaataatttgaaaatgaaattaagaaaatgatttcattttaatagcatcaagaagaataaaatactcgggagtaaatttaacaaaagaagtgcaagacttgtacactgaaaaatataaacaataaataaattaatatctaattaagtagaaagacatcccattttcataaatcaaaagatttaagattgttaagatggtaataaaccccatatgtatctaaagatttaatatagtccatatcaaaattccaacaggctttcctacagtaactgaaagtgtaatttgaaaatttatatggaaatgcaaatgatttagaacaccacaaaagcattgaaaaataataaagttagagaatacgtactacccaatttcaaacactcatgaagccacaataatccagacagtacggcactggcccaaggatagacatgtagatcagtggaaaagaatttaaaaaccagaaataaatccctgcatttatgatcaaccgatttttgacaaaacagctaagatatatcaacaggaaaaggatagtctcttcaacaaacttaataataataataataaaagaagaggaggaggaggaactttggctcttaaccaaccacatacatttaaaaagtaatgaaatagataacagacctaaatgtaaaagctgaaactataaaacttctggaagaaaacataggagaaaatattcatgaccttggtttaggcagcgtttgtgatatgacttcaaagcactattcataaaagaacaaattgacaaattagacttcatcaaaataaaaaccttttgtactttaaaagatatctctatttagagaatggcaagcctcatcatagattgggagaaaatattttcaaatcatatatatgatataggacctttatccagaataaagaagaacacttcaaattcaataaaaatataaacagcccacttgaaatgatcaaaatatttgaattgacatttcacgaaaaagtacagccactctagaagacagcttgggagtttcttacaaaactaaatattctcttaacatacaattcagcaactgccctccttggaatatacccaaatgaggtgaaaacttatgtccacacaaaagcctgcacacaaatgtttacagctttattcataattgccaaaatttggaaacaaccacgatatccttcaattggtgaacgaataatcaaactgtggtagatccatacaatggaatattattcaacgatttaacaaatgagctttgaagccacaaaaaggcatggaggaaacgtaaatacatgttgctaagtgaaagaagccactctgaaaaggccacatactatattattccaactacatgaaattctggaaaaggaaaaatgatagagacagtaaaaagatcagtctttgccaggcaattgagtggggagggagggatgactaggtggagtatgggggaattatagggcagaaaatctattcggtatgaaactgtaacaggacacatgtcattatatatttctcaaagctgatagaatgtagagcacaaagagtgaactctaatgtaaactatggactttagtaaataataatgcatcactattggctcatcaattgtaacaaaagtaccatactaatgcaagatgataataacgaggaaaactgttgaggaaagggtgagtggatgtgtgggaactctgtactttccactcatgttttttgtgaacctaaagctgctcacagaaataaactcttatgtaacccttgagaagtctcaacagacatggtttcctatttataattgtggccagcgcttgaaaagtcaggttggagaggttgtcaaaggaataaataaaaggtagattcctttcttctattctcaggatcattctgctgcattcattcattcactctgctgcactaaattatactgaacttttaatatctaattgatctaatgttttaataccctcatggatctcattattcttataatacactgagtctctgccatatattttaggccttaatcatgctatcttgttgcttgaagtgcaacattatcttctcaactagtgcttcttatccttaggggcacagaacaggaacccttctcccgtgttcgtcacagaccccagtatcgtgcagaatataaatcaggtttaaaaatattgcttcattttcatgcttagaacaaatgtattatagtttaagaacgcctgtatagtatggatttaccattgatttgaaacttagagcatttgagttaaaaatgcttcttcataaaaatgtcctttaaaaacataaagatatatgattcatcatttttcaaagttatataaacccccaaagcttctatcatcttcagctggggccatgaaactcctcacagcttaacacacagaagcaacattaaggtagctcttcacctttgtctcttctgctcggccatctcgcttaccttccatcctctctgaggacggatgaggtatagagaagaaaggataaggtgtgtcagcctggggaataatccagaaaggaaggagatcatatattaagtgacaataggcctgggcattgggagaaatgacttcggatatctttgaagtgagcacaccaaggggcacttctgtgtgatgagcataagcaaaggatgcacaaccatggacaaggaggtggaaggactacattggcagaaaaagaagagatttgaaaagtttaatttgtggtctgattatataaaacattgctatagttacaaagtcaaatctataaagtaagaaatactctgaaaagtttagcttctatctctgtccctttaccttattccataccttcaacacagtagggcttttagtttaaaatagagtctggctagcagcctctgttgaaacttctcttaacctgcagtgaaaacagctttgatgatatgaaaaaagacaactccaagcactgaaaactagccttaatgtcaatctgttttcagaatgtgagaggaatttcaactaaaacaaggctgatggaaagagatttaaaaacattgttgctggtccaccgtgctaagctcccttacaagtctgttggaagactctgttcctctcaatcctttattcaggaactcaaagcttatactaaccagagagttgggcatttagccttctacttgatggggcgtcattctacccctaccacgtccaccaatttgagactgaaattttcagaaagtggataggaagcttcctggagtatactgagttctaaaatgtaagctactcacatataaaacaccacaggcagaaattgataaattaaaggtccaaaggcagtgcacaaagggaattgtagtattttttaaattatctcttaattcctccaaataatgaggataagagactatttcagattagttcaataatcctgtgttacaaaatagtatgataattgcagagaattggtttgtagacaccaaccagtcttccagctattgttatgagaaagggattagctaaacagtgaggccaaaggcactcacgtatcttaccaatcacaaacatcagttcacgatattccttgacttgtgtgaagacgagcaaaacagaaaaacacaacagcacggtatctattaaaaacagagaaaggtatagcatctgaaaaactcaggaagggcaaagctcaaatccttaaaagatcagaagataccttcttaatgaaataagagtacaggcaaaaaaagacagtagaactatacataaaggagaatgatataaaaaagattacaattgaaattaaaaaccatgcagaattaaatcccattggaggcagtaaagagcaaaattcactctaaatagtatcaaattagtggagtgcaggtcacatttgggaaattcttacagaaggcagagaaaaaagaataagaatttaaactagtttacaatatatagaatagagtatgaggagttaaatttaagaatgaaagtcttttttcaggaaaacagggaactagaatacaagcaataatcaaattcatgattaagaaaatatcattaagagtaaaattgcacaaagccaattgaaagggctcatgatactccaggcaaaaatgattaaaagactctcaactttagacacatgctgacaatatttttaaatattaggaaaataggtttataagtacccatgttagatagcagagattaactacaaaaatgacaacatttaggctgggctcatattttcccactgtacctaatacaatgcctggtacttagccaaaactcaataaatattcattgaataaatgaataaaataatgaatgaatgtgtaatggcaacagaaaacaagactcagaaaataaaagatctatgctcttctaaaagcaaaaaaaaaattgaagaataaaccagtttcttaaggaattaccgaaataaactcatcacataggggaatgttttggtacatgaaccctggtagacttaaccacgggactgtgagttataaaaagttaataacaagtgttaaggacacagaaggcactgcagaagagaaacatattgactttgaatattgtcagtttacattcatggctactagggaagagggaacttcaggagggtctagagaacatgattaattccaaaccaaaatagaactcccatactaagaagataactataaattatttgaaaatttcagaaagaaattctaaaggaaggagatcactaaaatatgtgtatataccccatattcctgttctcttaggaaatgtttccttttgtcttggagatattggattttgagcatgtttttccagtacacattatgggatgagtaggatgattacaaaggaactattaggaatacttagaatagaagagactgagggacttttaagtcccttacgtggcttgtaagaacttgtacagctccttcgctggctgttcacaagaggcaaataaaaatagcatcacaagcctagaaagacttagtttgggaacaggtaggtacacgggactgacaactatcatgggagtcacaactataactttattgcaagagacatgaggaaattctatacctctgccacccagacctaagaaaacatgtagtctgttgaaggtattggtcactcaatcataatcacatcttaaaactacacactcttataggcataaccttttttttttaatcagtcatctattgccacactaatgctacataacaaatcatctcaagactcatatgtatatcaaaacatcttgttatataccttaaatctatacaataaaaataaataaaaacagcacaatggctttgaaaaaaaaatttattatttctcgggaatctatgggttgactgggtggttctgctgatctgatccaggctcaactgatctttgtgtctttggtcagctgacaagtttgctactgttccattaaacaaattaagtcatatgccaagcctaaagtcagggtggataggcactaccaaaaggtacaactatagaaaggtgtgaaatggggccacaataatcctactacattatggaaatggacagaaggtattcttatagtaaaatctcctccagagttcaatgacagtaaactaaaagcaattaaactagattatagcccacgtgaacaaatatccaatgcctagatataagactaaaaggaagcacaagagaatgttattatggtttttagggactgactttaattctttcgatattttcttgagggttttcaaactttctttctagataaaatatattttacaataatacatttattttcttgggtgtatctatcttgatgtggcaagtgtcattaacgctatcctttttttaatcacacagcttcttttccctcaaaactccttattactgtcaaatgctccaaacacacagacacacacacatgcccacatatatatacacactctcctttcacaacagtgcctctaaaacagctatatttttcctaagggttagctcgtattatggaatagttagagtaagtggttctcaaccttgcttgcttattggaatcacttggacatttgaaaaagaactgattactgggccccacccacagggcttctgatacagtagtctgaaatgtggcctgcacatcagaattttaaaagcccccccaacccaaattctaatatgcagataaagtgaagaaccactgatgtagtgtttgccacgactccttgtcatctgacattactatataattggcaatttgttcatctgttaagactggtgggggtgatggttggtggagagagagaacacagaggtgaatttttcacacaagcagtatgaaatgttttcataaggtattttaaagtgagagtccttttaaaaatattctattatcataaagacttacgctagaaaatgatgacaatgcaatcaatgaagtgaacacaaatcaacccttatagttagctttctaagccaaacataaccacaagattaagaaaacttttgagaagctaagagatacatgaaaaggtatgaattaaaacttttataaatttaagattttactgaagacaagacctacaatggagagtagattatcaacatctcgaagacagacagacaatgtattcatgatataatagatcagtgagttgctgttagatgagtaagatttagtgagctaccaactgggcataaggtaattgactcattctatagctcgcaaatactcagaatcccatgagtatctaggaaatgttttcaaataactaaagaatattttgttctcattcataagtgggagttgaacaatgagaacacatggacatagggaggggaacatcacacactggggcctatcagggggtaaggggcaaggggagggatagcatcaggagaaatacccaatgtagatgatgggttgatgggtgcagcaaaccaccatggcacatatatacctatgtaacaaacctgcatgttctgcacatgtatctcagaacataaagtataaaaaaaaatattttgaatcaacattctaaaatatttatcttttaaaactgaagaccaaaggagggtatttagaagggattagggtcatatcatgctggtataggattcaggttagttgatctaccatcattaaaggtattctaactagggtaaccatatggctggctttcttaagagtccctgtttatacctgttgtaaatcaatccatgcctgttacttatatttagttctgtatttcattttcaaaagtgttagttcagtttgaactaactagaattcatatttaaataatatattaaaatttctccaaatgtaatttaatttcacacaatttgcagcaggatcttaggtttggttataaatcccactggctagatttgtagtcttatttataagccaatatgttatattacacacaccagcgtatatttggaatgtctcttcagcttttcaaagagcatttatatctagcatctaattttgcctttgttaacgtcacaagaatcatatgagattgtggtgtagatgtataggttttcatgggacttttacttcatagggacaaatctgtaaagcacagtctcgataatttggttattttcttccagaaaccagaaggcagtgttgtctatgtcaaacattacattaacctattcaaccatagggtaggttactctgatttaggtggtatctccttcctccttgctgagccatttggaaagctgctaccaggtggaaaattgctctgtttagagcaattaagacatttcatgtgcgcctatttaaaaggcagaagctttagagcatatatgtctgccagttattatctataaaatgtcttaaggactatttcagagagaagggaagcccagcagctgtttctgagcttcctgctaagattgcatctgagactgcaattttatctgtttataggtttggttttcttgcaggcttttactgagagaaatatttgaaaacaagaaatatcgtccaaactgttcatttcacaggtaagaaaatgaattcagaaagcttgcatgcctttcaaagagtaattaaatattgtttttcaggtttcagcccacagcaaacccactagaaaaacaattcctcagcatgccaaatgttaaatgttgtccttaattaacttattctgaaatgttttctgggcagtactttctcaaactttggttataaaataatcatctctccacctgtactgggatgattgtatcataagacagagatgccactttcgcctatctggctccaattatgcaaaacagcatttcctttaattctgtttatctttgtgggaagaacagaggtcaaccaaatgcaagatcttccttttatttcccattttcttatttcctttacttgggaaaaatctgtaaggaaacatggccctgtgtagtgtctttggctattttgacttccagtaggaaaaagtgttatcagttaccatgacaaccacattttcccagagctccctgctgcaactcatttgcactaaacaagaacaaatcattattattcaatgaaggctctgataaagttcttttctttttggtcgttttcaatactccttgaaacccttctttctagaaagcgaaatggctctctagggagaatacattgagtttttctaagagaatgtcacctttaccacctatttaccaagcaagcatagtgcatgagtacagaccatgatatgtgaccttctgagcacttgtcagagatttctactatgagtagacttcgacttaactaaaagttcaaaagatgtttctgatatttcacaacttacctttcttcaaattctcatttctccgcatgtattgaaagatgactagcatcatcaaatttttctcattcaaaattaacttttcaaagtggcttacacaataagagcttttaaacttcatgatatcaataagatcagacatggagtaagtttcagatggggcctgacctaaaacattcaattactttacttttttctgccttctcctgtatctacttcctcctaaatttagttttccttatccacacacaatgtcagcctatggcttctaggaattccacgctttcttgtttgtgtctggcataaaataaatatatctcatgtagcttccagaaaaatctctcctcatacttcttgtgttgaattgggtcctgtgccctaaccctggatcaagtattatgaccagaaggatagaatatgctgactgatttgagggcctactccttggagtactggtgtggtgagggggtacaggtggaaggatggggaggtttcccatgaagcacatggaagagaggaatagatatctgaataaattaggcaacttttaccaatatgaacaagttggcactcagtgtctcagaatagcaaatattctctacaaccacagagcagatattctagagtattctacagttcctaagcccctccacaacaacagtctctctctctctctctctctctgtctctctctcacatacatgcaaacacacacacgcacaccgacacaatgccttcactaaatcatgagttaaattgttgccttggatctttatacctatgatattaataaaagaaatcttttgagagaagattgaaatgcctgttacaatcattgatatagaagattagaatcttctatatcagaggctggcaaactataatattttaggcttcgtgggccatacagtttctgtcccaactactcaactccaccactgtagcaaaaagttggccatagataagaagtaatcaaatggacatggctgtgttccaatacaactttatttacagaaccaggtatgggatgggtttggcccatgggcccattagaccccaggttgctgatccttgctctgtataataaattaaaatgaagtgaaaggaacttgtacatttatttttaactggtagagaaaactctaactcatcttgttttgctcttttttatgctaccaggaagctcagagctaaatttactgttccccttaataagtactgcttctcattctctttggtatacgaatatctttctttctatatggtctcatatctctgcttttatactgtaaaactttcttaactctgtgtcctttctaatattgtgaagtcttcatgtttgacatagatgaagggcaaattgtatttacaactttcagtgctctttctctctctctccaccacacacacacaagcacacacatacgccacggggtctcaatctccttcaaacccgttatacaaacagacaaactgagacccaggtatcaccataatcatgaagcaaagaagtgctagtcccttgactatcatcttgatctcttgtgtctgaactcagcttattctagaaatataataacagaaatagcaatacaaaggaacaaatattttctagaactgtcacattgccacagtgcaaattgttcctagttttaccttagataacataccactagacctctctttctctcttctttcaacctctctctccctctgtctgtccctctctccctctctcaacctctgctgcctattttcctcttcctgctgttgtctcacagcctgaactcttacaggctcatcttaaatcttggttttaacctgagtttttaaagtccctttgtctccctgcttcttctccttcaattatatatggatactgtggctttcttgactttgttgctgccctcataggattattgtttctgtgtccgttccaagaatcctccctagtctatgctcccactttcattcctgacttgctgtaatccctcaaatgttcttgaatatagtttcatttctggtctttggctttaatctgtggctgtcaacatcatcttttctcctgttcttttctacagcagctccagtccagggggcatatttttaatagccctaggctaaagaaccatcacaagcaactctcaaaattggcccttagttgccttagaaggtaaaatgcaaggaagagagaaaacaactaacagaagagtaaaccaaacaaatgcagtcatgttagtgtgcatagagtttagtttcattagcctctgctcaccaccatgtcagatggaaactgtgcataaacctccccagaaaggaactgcaagcctataacacaccaggcattaacgtgcagctagaacagatttaatggagaaacacatcatcttctccctatactaggctcgatgaaattatccaaaaaataattacagagaaaacaatgcactttaatttatccttggatattattattggaatgttcttcaactctatgatttggacttcctcactagagatattttattttggttttaaaaataactggagtcaaatatttctttttaattccaaaattttccaaaagactaagctttttcaagtacaaatttcattagggaccaaacaagaaaccgagcacatatttcactgaaattttctccttcccactgagactaagaaaataaattaggttaaaaacaaacacttagaaaaacaagtagctgggaagatgtactctgaagctttgctcaaaaagttgaggcagaggtttgtcaatatccggttagcgttattaaaattgaacagccttggatacctacatgcatgaaatactatgtgcttagggcatcaggaaagcaagaccttatgaaaatatttatttaaaagttatgaattatatttcaaagcaagcattagaatactcatcatcacagaaaaatcagagttttctatcatttggtactgtttttatttgatgttatttatcagcatatgggggccataaacttttagggatagggtctctaccagtcctattctgacccagcccacacagatgcacacatacacacacaccacacctgagctaagtaatttttgactcgtaagaatttaaaattaaaagccatccaattaaaagaatcacatttcaaaattttctagtccaattacaatgtaactcaattaaaaaataaacacagttctttgggaatacttctattacatgaagaaacaaacagtgatattatagtttgctttattaataactttaatcctattgagtatttgacatcacattttcaaactgcttgtaagtttttctttctctttagaaaataaagccatgagatgagtcaggtttatgactagctattttgagaagagggatggacatttcaaagaggtgaaccaactaaaattcacactcgtagaaccatgacgaaaccaagattacaaagcatttctgagatctttatccatggaacctaaaacccattctaagatacatttaaagaatcgtcatattacctatatgcataaaaataatgaatttctgatattagatgtgcaatcaaaaaagagaatctctcaagatactattttggaagtgtatgaaatgaaaatccaagtagctttatgttatcatgacattaaaaacttcctctactttctatattgtaaaattttctgtctttaaagatttctcaaaagagaatagaaaatccagtggtccaggacaagttaccacaattaatttttaaacctggttcacccatagtaagaaatgtggtaaattactaaaatcagttatactaacacattaagattattattactgtgatagtgatttatattttatcacggggagaagaacttcaagaatagccatctgaagggtttttactcacagcacttctgataccaaatgtgtggggtttttttcacaccaacaaccagttatgcaacaattcagacaccaactgcatgtcctagaattcaactcaattttggcacaaactacctagagttagcacaggccctacaggttgagggctcagtcccaagactgcccccacttcagatgcaagtcacaagtaccaggttgccatctgcacttctgacccatcagctataaactggggattcccatgatcccctccaatgtttgataatttgctagaacaactcacagaactcaggaaggtactttacctactgttactggcttattataaaagatacaactcaggaacagccaaatgaaagatatgtatatggcaaagtataaggggtggaggagcttccatgccctttccaggtgaactaccttctcagcacctccatgtgtttgccaatcaagaagctctccgaaccccattctttaggggttttataaaggtttcattatgtaggcatgattgactggccattggcaaatgttggaggctaaggctgaaagttccaaccttctgatcatgctttggcctttctggcaaccagcccccatcctgaagctatctatggcccaccaagaatggcatctctgaaacaaaagatgctcctatcacccagaaaattccaagcagttaggaatcccctgtcaaggaatcagggacaaagaccaaatatatgatttttattatatcacaccctctgattaactttgaaaacataattaagaattttgtttccttttttagtttgatacatgatgataatagagtcagaagcaacatttattttaatgagtattttgataaaataatggatccacggaagtggagaggtctgacaaattatggatcacagtgttcaatatctcatggctatatgagagttacaataatttcagatgcatttacatttcttgtacatatactaaaaccataaattatggatgagatgctgagagaatcataaaaaacccatggtacattcaatccaactttttctctctgacaacagtactaaggcatgtgtattctttaaacaaacacctcaaatatttactcatataatctcaaatatctccatttatttctatttcctgcaatagaatataaattctcctgacaacagttatatattccaaagcctgctctctattattttttaaaccccttgaaatgtttcctttcatcaagtttaaaatgaaaacagcggggcagggaagtgttaccttgcattggactccctgtttcctggtggaggtctttttctccatgtgaaaaatattccccttctctttttcttctctctcactaaaataactctcccgactccatttccctgttaataggatgttcctataattgaaaagaggaatgactaagcttagtgatccaggagctgccagctggttctcaaagggtagaactatcaagggaaagaaaggagcaacatccctccctttaacattctcctctacaatttaagtgcttcctctttttaatttccctgcccagatgaaatactagattttactccatgttctgcttctgttgcctggtgcttttacttcagctggggtcaaagagacgaaggcctgggctattaatctagcacagggagccagcaagtcccctctctaatgatgatgtataataactgtgagttaagaggaaatcttctgctttgcactctattaactacacttcattttttatacttaccaaacttagtccaacttagaaaattatcagtatttttccctcctattatcttctttttctttgaactaatggggaagccacttaaattaattaacttttggaaattggcttagaatatgtccagttgctctaagcctagtttcagttcaattctatcttcaaatgcatgattatttgtaaggcacaggcatgtggacctgatggaaattaatagtgttgagcattattctagaagtccaccagtctataaactccatgaagagagagaccatccctgtcttatttgctgttatattcttagggtctagtactgttcaggcacttgataaataactgttgagtgaataaatagatgtctttctccatcaagccatcaaaaaatattccaaatagtgtttgtctttataagctcaatttacagaacttaacaaagacctcacttaaatttgagtgatgttctatattaaactatggggactaggacattcacaggtgattctgtgtgatcatcattattattattataaatgatgttgtgacaagaagatgttactcaccagtgaaataacaacttacatcaggaaattagagcagaatagtctctcagctgagccattgtttgcttatttattactggtgttccatatttggacaatatctgccttccacttcatagtggaagtagagtacttttagtgctctgatttcaatgagtgttcagtacctgggaacatattcctaagaggcctactagtcactcattgtagagagtaaattatatataattatttccataaacatttaccgacttcatttatgtgtgggataatgtactaggtcctattgagtttgtccaatgattaggaaagagattagtcatcaaactaaacaaagaaaaacccagtttagccacaacacaaaccactccaccttcttcaatacagtttagaatatttttattcaagtgcattctgcaatatttaaataatgtgcatgaagggaaaaaacagaaaatctggaaaattttattattcagttggaatatgctagcatgtttgtgttaatacagtagctacctttaattattggttaatttaaactacttctcattcttttatcttagctctttttttccctcctaaggactttaatgtgactacatcttggaatgacttcctgcctttgcaggaaacaggcagcttcctgactgagacggaagttactagtccttattgccggttcgttttcattgtcctggttgccctcaaggttatccccaacctcagctccagttgtctgtttcccaaatttgactgggcttccttcatactatattgcatgacaaggtctagcaaaagattagctcagtctcaactctgtaaaaatggtttgccatttacacttctttctttcagcttcacagaagtgcagtctgtgcactcacacaggataccacactcagatgagctgcatgctgtcattattttgaaatgtttaatgattttatctttgaacttgtgttttacaagtaaagtccaatgggaccatgaagtatgcattatgcataatagcaaagaggatacgtagaagaaagaagaaagctttatattttaacacttcctttgtgcttgttcaacaagaggccctgcagttccattttgaactgggcttcacagatgatgtagccagtcctgctctgaggagaaatattggaaaatgggatccaaactagaatttctcctaaagaaaacgtcagagaacttgactttcaaaactgctctttgaatatcatcaaaagttttgctatagtgaatctttatgataaatacagtacctatctagtaaagcaatttaattatcgcaggctgtactaataaccataataaactccactccaatagtattctacgtagacaagtcttccagcctcgggcctctcctcattaaactgcaattagtatgataaatggagagtgtgattttgctgcagccagtattagccctacttactcatgaggtgacaggggaagccatcagagacagaattaaaaatatttaaataacaaggaaaatggtagggtttgctgccttctggccattagtccaacacatctgtgtgcaggtacatctcacacatttcagctgtaactgatgaagatctcagataagcactgatgttaatagcagttaatacaacccagtgactaaacatagtctgtccttggaaggtcataagtgttgtgagaattcaagatgactataatcttaacaaagcattaatgggcaatctgactaaataagatggctgctatggaggacttctaaaacactgtgcattcttaatcaggtgatgagatatttcacatttgctaatggtatagtccccacggcattgtagtaccacatatattaacatttatttaatttaaaatgcatcccttaacaagaacgctttggtggatatggctttattgaaacctaaagctaaaacatattacataattggattctaatctgtgaaggcatgctatactccagtaatcagatttccggagaatccctgtatccttgcagtatactcagttttaatctgagtttctctgaataggtttctgttccttaacatcaaatattcctcaaggaaagataggttgaaaattataattttaataaataaatactgaggggaagaataccttacacaaaatactctgtcacgttctgctagatttttaaattcttttaaaagaagtaccatctactatatttgattttacttggtcaatgctagaaatgatggttatttttattttgttctcatccaaatattttatcaccaaatggagagggctaccttggctttgggttgcattgattcaccattaaagtttattgtaaatgtgatttaaaaaaaaaaaaaaaaggtataaatccacattttattcagatttttgtgtcctttaaaataaaacactaaaacatagtgtgtcaaggactataatctcttgcaaatgaccccaagcctgtgtgtccagtcctgacatttgtttctgagatctgcacccaattccaagccctctaccaggacctccattcacaagaggcttccaagtgatcttcatcctttgttttctcagttcactaaagagcagcaagctaggattcatcttgattgcctccttttccaaaatttatttaaattttgtcatcaaatcctgtcaattctgcctctaagacatctatcacattctcttctttggcactcccacagacatagtggggagttatctctataggttctgtttttagatttatcaatatttccctccctcatagaattgccatctccactactgttactgatcttgatactgtacactgccactacatctttactttgtacttatgggatatacaaatatttcaattaactatgacttcaagattaatgcatagattacttaactaaattactacttaaactttatgtattaacatcattagaatataaaaatatttatcaaaacagaaagacctctgtacctgttaatagtatgtattaatttgagcctcaattctcaaaataaaaacaaaaattaatggtgagatgaagaataagatgatatttactatctatgcagagcatttcccttgtgccaggcattgtgttaaggattttacatatattatctcatacaatctttgtaaaaacctagtgaagtagcttatccgtcaagtgcacgttttaatcatactttgtcttctacatacgaagagaaacactggtgtctgctagctgatctgaagcatcagagcttgtcttgaaagtttgctgcttttagtgacaaatgtttctcatcacatgcttactcctattattccagttagggccttatcgcttcagatcctgttggccttagtgaagaaaagttcctgcaagaggcatactaccttgctttgtgtgccttcattccatcagctttcacatcctgcccttcccctggtacccagcagcagggttgaaaaaaggccagggggtacatggtgcgatagacacttggtgtgactcatcctctgagagtttgaagtatggaaaatttgcttatgccagtcattgctatccttctatctccttaagaacgatgaatctgtatagatggatctctcactgtagcaggcccagagcagagttttcttttttccaacttgcttttcaaataatttttactctttttctttttgaatatgtcagaaaacacttggaacaacaacaacaacaaaaaaaaacactgaatattctttactgatgtttcctcatgatctcaaatgcattatgcctatccatactctattaacacgttcaaactgtttgtcattacatttcattaggggacaacattcaatcttgactcataagtacaactgcattggaaagcaaatggggtagaaagggaagaaaagacttactatggctggccactagcccttcctcttaatgttcttcaagccaactttgactggatttttcaggcctcagcaagaggttatacactgtacttaagtatccatttatcctcccttacgcttcaccctctaagaacactaaatgcttgtagtttttctaacatgccaagctttttcatatcttggtacctctgcaaatactgtttcctttgtctggaatatttttctccccctttttcacctggtaacgttaaagacacttgaaaatctagtacagatgactttccttttaatcaacttcgtcctggaaagttaatcacattttcagtgattaacttgtagatatgaagtactattgatacatatatcacttgggttataatgtccttctttgtatgtccatttctatttcttcttgagagtagagcccattcctagtgtaattccctggcacttagtagttccaaaatttacaaaaatttagttgctgaataccaactaaaaaaaatctgaaattacatcaatgttaggttgtagatttttattttcctatgctggacaatataaccttttcagtgcagagatactgtttcccctctatttgctccactcactagaactaaagtacatgcaatgtccaagaggactggtgataggtaattactcttgtcaggtgctttcgactagcatcaaaatcaggccctttatagcacatattcatataaatgacagctcaagtcaaacctatctatctcccgaaatagatgaaaccatttcccacccttcaaacattcttttctcttctctaaggttacgtcaaaaatcatcatcattaatagtcaacatgtccacttcactcaatgaaacttccaaagaatttgttattcttttagaattctatacgaaataacatccttccaaagcaactacgaagctccaaagaaaacacggtggaaaagatacctgtcattagcagatatctaccaatattgtcatcagtattatcactgttatcattgcataataaaggcctttgttatcaaattacttcatttgaattaatatgaaatcactcatggcattttttcattcattcaccgattgatttattccttttcttgcacctcacctccctcataatttttgacaccttataacttttttttaaactggaaaagtataattagatgacacaacaagaattaaaacacatactcactaacactctctctctctctctctctctctaattctgatgaaagatggaaaccatgttaacttccagttctggtgaaacttttgactgtgaaatacatttatggaattctgtaaggcctctgtaaaatgtggcaaaatcaagcaagtttctcaaaaaccatgtaggatatctagttaagtaaaaggataagaaaaaaagtatctttataaaatgggaagactgacattatgtctattattaaacagtgcttcttgttggaagaacagatgatattctgagagaaataaacactcttgtccatttttatatcatgaacaaactaatatttctagggaagaggaaagatggtccttcacgttctctttgaaacaggaatattcccactatacagaagaattgtattttagaaagacaatttcatgaactaaggctgaaaatctcccagaccatggctgctatgacttctcaaatcagcaatcatgcacagaaaagagtgctaaaagagacccctctcttttcttcccatcctcagcctttttctctctatacttttcaaaagctcacagacagtaaatacccacacaaaagaggaatcacaaatgacaaattaaaggtaagtttctcgcatttgccagagaggatttagaaaatgtgccacaattttatacaatgctggtgcagcaggtgagtctagaaagtcattttggttttcgatttcagaaataattctgttttatactggcagattaacactcttccaaagatgaccaaagtaaggcccagaattaagtcatagttgtacctcttctgctcctttttctgtcttgctgaatttaataatttactcttcaacattccactaaaagtattgccaattttattagtctttaaatcggccagaaaaagacataccacccaatagcaaaatagccaagaattcaaacaagaatgaaaaggggtatttaaatacccaacgaatatgtgtgaaggtgttctgagttgctaatcatcagagaaatgcaaattaaaaccacaacgaaatatcaccatatactgaatagaatgacaaatttttaagaagactgaaaatctaaaatattatgaggatatgaagtaagtaggaattccataaactcttggtaggattgtaaatggactcaactactttgtaaaactgacactttcgtcagcacctacacaagtggaacacaagcatatatatattttcaactgaaatatgtacaaaaaaatccatgcacaggagtgttaattgcagctttcttcataacaacccaaaacaagaaacaacataaatgttctgccacagtaaaatgtataaatatttgtggtaggatcaaccaacgaaatgttatatagaaataaacattaatgatatactgctatacatagaaaatacatgaaatacacaacataatgttgttggagaagccagacacaaaagaatacatacctgaccacttcgtttacgtaaagcccaaaaaagtgaaactattccatgatgttaggagtcaggatggtaatctttgggcaggaaggggtggtggtgatcagaaggggcgacaaagggggcttctggagtgttgttcatggtctgtttcttgttctgcatagtacggttacacacgtgtttttactttataaaacttactgatgaacacttttgcttcactgctctctatgtatgttatacttcaattaataagtttatttaaaaagaaaagagagaccatgacaagtactacttatacactaagtttgtgtgaaatacttttttttttttttaactgttaatctccagatagtccctttaaatccttttcctctccccctaacctccccaattcccactttatttgactccagctatgatgatttctcccctggcagcagcagcctgtagcccagccaatgttcttgcctgcagtctggtctcagtcctattcattttcattctttactttgcaaataggatatttgtatttttaaaaacatcctgtatacaaaatagtgtgacaataaatgtacagtttagcgaatatgaacagaaaataatttcgcaaaatcaacacctttctacttacaccatcctgcttaagcaacagacactagttttttcaaatctgttgtcccttgacaatcccaatctccatctttgcatcagaggtattcaatatcctgaatttggtgttaaacatctccttgcttttatttatagttttataacataaggtagtagttgtaaactaaatatcaacactaactaaaaatagtttgagcaatattttgtttggttttccttgttttgatttttttgttgttttacttgttttgaaatttaagttatggaatctcacaagtgtattcggctgtaagcttttttttttctcactggtatattggtatgttactgagattaatccacccagatgcctgggcctttattccattcttttttcactgctgaacaatatccattgtataagtacactacaaattacttattatatttttaatatgtgtattgttttcagtctttttgtcatttcaaatagcaatcttatgagcattcttttgtgtacctcttgaatatgtacaagagtttgtaggttatacatctaggaatggaactactgggtcctcaagtatgcacattttcaaatttactaggtaatgccaaattattttacaaagtaattgaaccaaaatgattccccgttgtctgcatctttacttagtgttgtcattatttttagtcattctagttagtgtgtaattttatctaaacatttccatatattcaatggcatttcatttgaatttcctcttctatgaaaatactaatcatgtaatttgctcatctttccccctcaccgtagcctttttcatgttgatttctgacagtatttatatactctgaatatgacagttttttcagtaatcagtgttacaaatatcgttttccactatgcctagtcttttctctctttattcttcctttcaataaagagaagtccttaaattttatatatgaaattatcaatattttctttaatggcttgtgcttttatgtcttatttaataaattcctccctacccaaaggtcataaggatttatcctttaatttattgcctttcacatgtacgaccatgatcaatatggaatttatttttgtatatggatgaaatcgatgtctgtctactgttacgttttttccacatagataaccatcacttcccttggcatttaacgaataggtcatgcataccctgctgatttacagtgattctctgtcatacatcaagtttccattcacatttgcacctattttcggctcatttaccactggcaataccaaagtgtctcaagacattacctttttaaaagagaaaactaaaaatatttgtattcattaagttaagcggaattaaaattattagccttaatttagtgactaaatatttgtgttttgcagtgaagatccaagaaacaaacaatagcatcaaataaaaacatgaaaatagttcttttgcagcaaaatttatctgaaaactttcattgcacatagaataaatttctatccactcatttaaaaattcaagtaattatactttgaagtgctttcagtgctatctttataaacctgtataagctaagacatttttgactacacatgaattatggttttgttaaaattctttctgggtcaagtgatatttttcttaatccagggaatatctaattagaaacaaagataaaaatctacttatcttcagttcttaattatcaaatttattcaataaagtgcttttacttttgactgtgactccagaaggaaatggtgccaatattaatcacagtattttcataaaaattttttaatctttttattctttttatttcatacaagaaagtttatgtattatatatatatatatttggaggaatatatataatacatattatatatataacataaggtagtagttgtaatctatatatatatcaaaacaaataaaatcaaagcaagcaaaaccaaacaaaatattgcttaaactatttttagttagtgttgatatttactatacaactactaccttgttatatatagatattttaatacattatatatttatatataatatatataattatatataatatataaaattatatattaatatataattatatatattatatacattatataattttatcgctattatatatttatatattatatattttatcgatattatatatttatatattatatatattatcgatattatatatttatattatatatattatcgatattatatatttatagatatatatttttatatattatatatttatagatatatatttttatatattatatatttatagatatatatttatatatctataaatatatgtctataaatatataacatatattatgtgtaaatatacaatatgtataatatatattatgtataaatatacaatatgtataatatatattatgtatatacaatatgtattatatatataatgtataaatatacaatatgtattatatatataatgtataaatatacaatatataatatatataatgtataaatatacaatatataatatataatgtataaatatacaatatatctaatatatataatgtataaatatacaatatatctaatatatataatgtataaatatacaatatatctaatatatattatgtataaatatacaatatatctaatatatattatgtataaatatactatacataatatatatattatatatagtatactatatatactatatagaatatattatatatagtatactatatatactatatagaatatattatatatagtatactatatatactatatagaatatattctatatagtatactatatataatatatagaatatatatattatatataaatatacatatataatatataatatacaaatatactatatataatatatataatatacaaatatactatatataatatatatgatttacaaatatactatatattatatattgtatataatatataatatatacaaatatactgtatataatatatattatatataaatatactatatatatataatatataaatatactacatataatatatattatatataaatatacagtatatataatacatattatatataaatatacagtatataaaatatatactgtatatatatataatatatatttttataaataaataaacatagtatatatataaaatatatatattcctccaaatttctttattcactcacctattgatggacatttaggttctgtccatatcttggctactgtaaataatgctgcagtgaacacggaagtgcagatagctttttgagatagtgatttaatttcttttggatagatatccaaaagcaggactgctggataaattttaaactttttgaggaacttccacactggtttccataatggctgcatcaatttacatttccaccaacagtgtacaaggattcacttttatccgcatcctcgacaacatttatcttttgtttttattataatagccgttctaacaggtgcgaggtgatatctcactgttttttacatagaattcttttcatttttatttatttgttgttattgacaaattttaattgtatatatttatggaataaaaatcgatgctatgatacatgtatataatgtggaatgattgaatcaagctaaataacataaccgtcacttcaagtatttatcatttattcctcctgtctaatgaaacactataccctttgactaagttctcttcattcccgtatctccacagactgtgataatgaccatcctactttctgctcctgtgcatttgatttttcttagctttcacatataagtgagaacatgtgctatctgaacatctgtctttctgtgcatggcttatttcatttagaataatgtcccctagattcatccatgttgttgcaaatgacacagtttttctcttttttaaggctgaatagtattccagtattccactgtgtgtgtatatatatatatatatatatatatatatatatatatatatatatcacatttatctttatccatttataggttgatggacacttatgttgactccacaacttggctatcatgaatagtgctgcaataatcatgcgggtgcaaatatgtcttcaacatgctgatttcaaatcctttggatatatacccagaagtgaaatttctggattctatgccaattctctttttagatatctgagaaacctccatactgttttctactgtggctttactaattcacattctcaccaacagtatgcaagggttctctcttccatatccttcaccaacacttgttacctttcatctttttgataatgggtattcggacaaacatgaaatgatatttcattgtggttttaatttgcatttccctgatcattagtgatgttgagcattttttaatttatgtgctgccatttgtatgtattcttttgagaaatgactgttcaggtactttgaccattttttaatctgattattttcttgatattgatttctctgagttacttaaatattttggatattaatctcttatcagatgtacggcttgaaaatatattctatcatttcatagtttgtttctttactctgttgttacctttgctgtgagaagtttttcagtctgacgcaatcccatttgtctattttagcttttgatgcctgtacttctggagtcatatccaagaaatcattgcccagaccagtgtcatacagcatttctcctacgttttttcctagtacttttatagtttcaggtttatgctaaagtctttagtccattttgagtggatttttgtatatgctgtgagatagggtctaatttcattcttctgaatgtggatatccagttttcccaaaaccctttactgaagagactgtccttttccattgtttgttcttggcatctttgtcaaaaatcaattcactgtaaatgcatgggtttctttttaggctccctattcagttccattggttgatgtgtctgtttttatgcctgtaccatgctcttttagcccatcaatccctggtgttccattaatggaacgctaagcatgtgggagttatttatatcctactgttaagttcatcgccaagatctgactgcaaaaattccaaaagttacaacctcaggcctaaatgggttaattactacatctttgtaatatagtttgaagtcaggtagtgtcatggcttcagcagttttctttttgcccaagattgccttggctatttggtggggggtgtgtgtatgtgtgtgtgtgtgcacgtgcacatgtgcatcatgtacgtggctccacaggaattttggatttttttctatttctgtgaaaaatgacattggaattttgataggaattgcactgaatctatagaccactttggggagtctggacattctaacaaaattaactcttctaatccgtgaacatataatatcttcccatatatttgtgtcttctttgacatctgtttctttcatcaaagttttgtaattttaagtgtacagatctttctatagtgtagcagctatcacgtttgcctcactcactgcggttttcatttgcattttcctgatgattggttattttgagtacctcttcatattcctattggctatccgtatgtcgcctttgagaaaatgtctactcgagtcttttgcccacttttattttttatttttttgctatttagttgtatgaattccgttatatattttggatatagatcccttaacagatatatggtttgcaaatattttctcccattctgtagactgcctttccattttattgattgtttcctttgctgtgcagaagctttttagatacagtcctgcttatctatttttgctatttttgcctgtgtttgggggatcatatccaaaaaatcattaccaagattactaagaccaatgttaaggaacatgttccctatgtgtctgtttttatggcagtaccatgttttgattactatagctttgtagtacaatttaaaatcaggaagtgtgaggcctctaactttgtcctttttttctcaagattgctttgcctatttagggtctttcatggtttcattcaaattttaagattgttttttctatttctgtgaaaaatggaatgggaattttgatagggactatgttatgtatattgctttgggtggtacagacattttagcaatattaattctttcaatcaatgaacgtggggtacctttccacttatttgtgtcttcttcaatttctttcatcaatattttacagttttcagtgtaaagatttttcatctccttggttaagtttattcctcagtatttttttatgctatggtaaattggattcttttgttaatttcttttggataatttgttatgatgtaaagattttgctgctgatttttgtatgttgatttttataacctataactttgctgaattcatttattagttctaacagatttttatggtgtttttagagttttctatatataagatcatgttgtctgaaaacagagacaattttacttctgcctgtctgatttggatgtcttttatttctttttctcatttaatttatctggctacaacttctagtgctatgttgaatagaagtggtgagagtgggtatccttaccttatgctgcattttaggggaaaaacttttagtttttcctcatggattatgatgttagctgagggcttttcataaatggtctttattgtattgacataaattccttgtatacttcttttgtttagggttcttatcatgaaagaatgttgaaattcgtcaaatggtttttctgcatctcttgaggattttttgttttgttttgttttttgttctgttaatgtggtgtatcgcattgattaattcgcatatgttgaaccatccttgcatcccaggggtaaatctcacttggtcatggtgtatattccttttaatgtgctgttgaattcattgtgctagtattttattgaggattttgcatctatttcattagggctgtaggcctatgattttcttttctgtcatgtctttggttttggtatcagagtaatgctggtctcacaaaatgaatttggaagtgttcccccttctattttttggaagagttggagaagaattagtattatttcctctttgactgtttggtagaattcacccttgaagtcatcttgccccgagcttttcaagaatgcccctctctctttccatctgaccctcctaacaattctaactattacttccttctagctatcttcccttattccaccagtggtaagtaatcttttctttcataggaactgcactgggaatattcagttctattaaatttgcagttaatcttaacctgactgctctatgccatcttttttattgttgctttgaattttgaaaatatctgtacattgtgctttgtgtcttaaccacgtattatgaccctggagggcatgggttttgttgtataactcttttggccctgtggaatcttgaacctagacaattaaacaatgtttgttcatatgtacaaattaatttataagttgtccctaaataagtggctctcaaacttgaatgtgcatcagaattacataaagggtgattaatgcagatgaaacatggattgctgggccctaccctggggattctaattcagtagatcttgggaagagcctgataatttttgtatctaacaaattccaaaatgatgctaatgctgctgggaccagaaccatactctgagaaccattgctttaaacctttgtgtcttgagaataattgctatactatggttcctactatctggtcctaaatttctacattagtatctgtctctttgtgtaggtttatagaggatattactcatttggaaataatatatactgtaatagtcattcagccgtggccagtaatcgtttcaaatctactttggtctattagttctagcctttttgttcctatcaagtagtattataaaccccaaacaccacgcactcatagtcctacatcctacatccccttttttcttggaatgttcagttatctcctcttgtcattaagattttataacttagctggaattctttacttttctcttaactctagtgctcaccttgtctattgatactgtgcttttaagaggacatctgtaccacctgtttcgtgaaagagggtcattcttacaggtccattcttccttttttcttgatatgcatctggaataaaagcatgataaaagctagggtgttgtgagggagggcatgaatttgagggtgctgaatttggaagggattggagaaaatattttcatataaagtttaccctctatgaactttcaataagaattgactcctttgaaaaatccttacctactcccatgattctggtacggaccagggttcaataactcttctaagaacctataagcctttctggtctctggacttactatatttttagctcttttattatctccttggccatgttgtatgtataaagttctaataatgttttaaatgaaggccatataccaatatagtagagttctagactgacaaagttggctttgaggaaaaaaggcgaatcacaaagtgcttttaagcatgaattgagcacaagaggagagcatgacagtaaagaaaaacattttactattatccaagtaagtctgaaatatgtcttgtaaagcagttggtggagctaccaaaaatgaattaaatgagtttatttgtatggcacttttttttggtttttttgagatggagtctcactctgtcgtccagactggagtacagttgagtgcagactggatcttgcctcactgcaacctccgcctcccgggttcaagcaattctcccgcctcagtcttccgagtagctgggactacaggcgcccaccaccacgcctggctaattcttgtatttttagtagagacaaggtttcaccatgcttgccaggctggcctggaactcctaacctcaagtgatccacccactttggcctcccaaagtgttgggattacaggtgagggcctgtgcattttaacttaagttctggagtgcgttgtgtgacagagtattcatcccaggggttggcgaaagaactgagatgaagaaggccagatagtagtttgtctaaaatattaatttccaagctaagactcatagtgaaatatcagatactatggcagtgagacagagatgcatgaaggggtttaacatgtttttgtgagggattttgagtgatattggtgccataaaaaaaaactgctttggtgcccagataacaaaatgtgaaacagaatgggtaatccccattctcctcatctcagtttctagaggactctcaggaacatgaaaccttcttcacaccttaaggtttccttgtggtgaatcctgagtgaaaacactcttggcccagatattaaaattcttgtagaaagcactgaaaacaatgacagtgatgagatgccgccttcaagtaactttacggacaacctctaatattaggaaagaaggtagtcatggaaagatgaggggaaacaaagacatactcccaaatatatagttcctgagttgccactgaagtcctgaggacctcccgaaaatatcttggcaagaaaatgaggctgtgagatgaaggggatgactagtggcttaagatgctacattatcactcatagaagccacagacagttaattggttacttatttcacctacagccacaaactcgtagatttagggaatctcaattctgactgtgttaggagaagaatctggaaaccagctgaatataaggaaatattttgtgtttgcttactttactttgcaaagaaatctcatgacctaaaataacagaaataaataccaatttgccaaaataattttgtcatgttgataaatgaagaaaaaaatgaaaagggtcactgagaataacagatcattatgtactatttaaaatgagacaaatttaaccacatagaatatcttgtgaattgcaaaggtgtcaaatgctgcacagaaaaggatctgatacagtaagtagaataaaatgaggatgaatggctaattaaataccccctcgtaaacttgtttgtgattgttggacaatattgtattgcttgaaattcacatgttgttttattttaatttttaatttttgtgggtacatagtaggtgtatatgtttatgggttatatgagatattttgatataggcctgcaatgaataataatcacatcagggtaagtggggtaaattacctcaagcttttatctttttgtttcaaacaattatactttttcagttgctttaaaatgaacacttacattattttttactatagtcaccctgttgtgttagcaaatactaggtcttatttattatttctaagtatctttctgtactcattaacaatacccccctcacctgatacccttcccagcctcaggaaaccatcctattactctctatctccatgagttcaattgttttaatttttagctcccacaaataagtgagaacatgtaatgtttgcctttctgtgcctggcttacttcacttaacataatgacctccagttctatccatgttgtcgtaaacgaaagggttgcattcttttttatgcctgaatagtactccattgtgtatatgtaccacattttctttatccattcatctgttgatggacacttaggttgcttccaaatcttggctgttgtgactagtgctgcaataaacatggtaatgcagatatctctttgatacactgatttcctttcttttgcgtatatacctaggagcggggttgctggattgtgtggtagctctagttttagtttttgaggaacctggaaactgttctccatagtgtttgtactaatttacattcccaccaacattgtatgagagctcctttttctccacatcctcaccagcatttcttattgcctgtcttttggataaaagccattttaactgtggtgaggtgataatcacattgtagttttgatttgcgtttctctgatgatcaatgatgttgaacacaaatggcctgtttgccatttgcatgtcttcttttgagaaatgactactcaaatattttgcccatgtttttattggactattagattttttcctatagagttgtttgggctccttctatagtctggtgattaatcccttgtcagatgggtagttcacaaatattttctcccattctttgagttgtctcttcactttgttgattgtttccttggctgtgtggaagctttttaacttgatgtgatcctatttgtccatttttgctttggttgcctgtgcctacagaatattactcaagaagtctttgcccagtccagtgccctggagagtttccccaatgttttctttcagtagcttcatagttggaggtcttatatttaagtctttaatccattttggtttgatttttgtatatggtgagaggtaggggtctagtttcattcttctgcatatggatatccagtttttgcagcaccatttattgaagagactgtcctttccccagtgtatgttcttgttgaaaatgagttcactgtcagtgtgtggatttgtttctgggttctctattttgttccatgggtctatatgtctgtttttatgcagtaccatgctgttttggttactatatctctataatataatttgaagtcaggtaatgtgattcctccagttctgttctacacattgtttttaaagtaagaatcatcacattcagacaaaaacaaaaacatgcttagtgaatgtaaattttcatcaacaatcttatgttttcaatgaataaacccagaataaataatgtagagacaatataattttgggtttgccatttgggtattggtgccatcttcatcacttattaatcccttaactctattgctgagaagtttataattgttttagataaatgtcctatgcaaagggttttgggactatctggaaaatacagtgattaaaagatatttcttttagatttttgttttccctgacattgaaagcagagcaatataaaacatcttcatttgtgtctaagcattttaaagtcatgcattacatttaaatagaaaataaacatgaagccaagaaagaaggtcattattcaaaactcactttaccactgactcatttaaaaattaagtcaagtaattcacaaaaccattgttccttactgaatcacaacctccctgtcaattaaggaaaaaggatcaaaataaatatcttgcagctatggcaacacaattttcaaaagactataaagataaacagaaatgtgttttcaaaagaagaaattttcttcaaaacatcagatgcatagtaatagatatgctgtggtattagataggattaacacacctctctgacacacacagaaaggaataaagaacactgagtgtaacagtaagaaaagcttagttgtgtggcatttttcttcgtaattttattttaaaaatctgacgctagggttataatacccaacgcccaaagtaaatatacttttggtaccttttaaaacactatttcaagaaaattgagtagctctattttgctttacagcactgtagatcaagcttataatgaaataattatttgagtaacaatttttaaatgtcttcctcctttgccaaatctaagatttcatgaaggaagagaatatatctctcagtttcttcatggaattgcgcctactgactgggacattataagtcctcagtaggaatatttttgaaagaataaatgagttactgtacattctcttgaacatagttttgacaatggtcataatttattgtattttatttatttgactatttatacacacatattaatttatacattagtatttacaagaatttgggtttctggcctatatttaaaaatctaacaagcatagaaaaggtttatctgtggcaaagcagaataaacgtttatctgaaaaagatcctgaacctcaaatatctcccttcctgatccctcatagtccaccacttaagatttctttctatttttctgcactactttttccaatggtcttatttgagaatgcagattctctagggagaggctttccagagtctagaatatattagtgtgaattagttttgccatttcacttttctaattgggtttttctggcaaaaacttcatactgaaatgatcttggcacaatttttcagtctcttgattagtgcagtaaaaatatatacaggataaagaggatggaagtttctaatatactggaggggagggtcaggaaaggtgtactttctatttagttgacaactctctaccgtaatgatttattcagtaatattttcaaatacttaatcttctcttatatatcctggaggcgattgattggagttgttggtagctgaacctttctgatatgttttcggtaaaagtgtattgacatatggctgggcgcggtggcttacgcctgtaatcccagcactttgggaggccaaggcgggcgatcatgaggtcaggagatcaagaccatcctggctaacagggcgaaaccctgtatccactaaaaaaaatacaaaaaaattacctgggcgtggtgacgggcgcctgtagtcccagctgctcgggaggctgaggcaggagaatggcgtgaacctgggaggtggagtttgcagtaagccaagatcacgccactgcactccagcctgggcgacagagcaagactccgtctcaaaaaaaaaaaaaaaaaaaaaaaaagcaacttaaacacataaaatgttcaactcacaaatgtatagctcattgaatttgtgcagagttaacatattcatataacgggcacccaaaacactagcagctccactaaagctccccttgcacttccttccggtaactgacttttaacaccatatataagttttccgactttttagctagcagctctctatagaatgtgtaggcatttatcatctattttttttttcagtttttcagctctagccaaaattctgagaaagaaacacaatcctattcgatatcctctgacatgtctataaaagaccaaacctcttaaaataattttgagacccacccaaaggagaaataactgtaatttttacatttaatgtttgatgtatttttccaaaatcatatcagagagttgatttcatctgttcttattacctcttgccttgaaaactggggaaatcagcactcaaattttcccccagaagtaattattctcaaagggacaggttctagtcgatccttcatttacactgacttaaaaataaaagaaatccaaattctcaatgaactttagatttagaagattagacctgcaagataccataatgatcattccacacagccaactcaatttacaaatgagaaagtgaaggcctaggcaagtgaagtgtttcatcacaatattaggttaggcagacctgtcctaggacctaagtcttcctaaatagggtgcatggctcttttcaaactacaggcagagatacttctgtagagtgagatagcctggatttaagctctggcttcaccactgactagctaggtgagcttaggcaaattgctcatgtctctgagccttggtttactcatcttcataatgaattattatggtaattgaatgagataatgcaggtaaagtacttagtgtagttttcagtatataatcaacactcagaaagtgaccattattgctgctgccatttttgatggagaggaagaaaaccaggtgtgacttcactgcatacattctcataaatatgaggcatcaggcatttaaaaacatgcttagagatgccataatggggtgtggcactcatgtctggcagccttcttatacactctagttttccctgaaacccaggaacaagactgttggtggaggaaaggaaaaacaaaaccaactaatatgttccttagtcactggacctcagcactttttgtagcattaaatgtcatagaataaatgctccctcagaaggcttaccctctcaagccccctcttctattggagatgtggggaatcagaaacattcactgaccaacagttagataattatctatgactgtcaaaatacctcagaataacatctttgggaggtccagcaaaaatcaattataaatggatttattagagtaaggatgttcaccagaaagattatttctcaccacttacctcacatatgaagagttacgaaacttttttctcccttgatttggacaccagtacaatgtagtctaagaagaattgactttattagcagactcatccatcattggatcattttgttcttgtggtccttgcagtcgtttgacatctggtgttagcaattcggtccaggtttttaacatctgaaaattgagcatcgtatctcctatgcctgcctctgaatattttcaaatttaacaggctagaatggaaggtagtaatactatgtgatgtacacatctgctcccattacacaaatatttatatggtccattatccaatgcattttggatatagccattcagacacctacaaatccacttaagtgtacaattatccagttcctttagtatcctcttctccaccaaaacaaagtgataaagaatcctgcctttcccttacagaaacgacaagaataacctcatgaacttctccaaatatatgcacagttgctaaaatatcaactaaattatattggccaatcatactacacctacttcaggtcagaatcctttttctaaaacttccttatttcgcttcaatctttgttttgttaacttagaaaaacaggaaaaaaattgaagatcagcttttattgacatctaaatatacattctctgaaatgagcacattattgaaagtattactagtcttgttcgcatactagacataattttatatttcatccagtctagctacccaaacaaacactagattaatccatgcagtaggtatcaggtaaacagcataagattctatcacacacttctcaaagcaagtatttaaatgcttcagcatctgggcgacagagagagactccatctcaaaaaaaaatgcctcaacatcattctgattcagtaaataaatgagagtcctagcaatctaagaacttttctactcacatggaggcttgcttgtttgacagtctctctgggagtttcaagacacccatctgcagctgttctactttttactgggctttatgaaacacatgcctcacaaagaaaaaaccatctgctcattcaggtgcagagtaatacttgagcatacttgaggaaggagaagagaaaagtggtcactggaaatggatgtggttttctgggggtccgtgcatgaattatgtaacaatccatttcttgtcattatttaaagccacaattcataaaaggaatacaacgtaatcatgatatattgatgaatttggctagacttcaaaaatgttatctaaaaccaaaaggaatttttatggttttgttttttagttgtacttatttgtaccagttatttagtcttttgtctctcagcttcaaatatacccttgtgtattctacaatgctaaggctggaactctgaaaactatattttctagacactttgccagttgtcttcccattagcttcaaccaatagaagacgctagagagagattggaaagcaagggggaagagagggagctgtttttgtttcatgccccagttcctttcagtttaatttcttcttgaaattaccagaaccagcctcattgtgccaactcaaaggtaccagaagtattcaggtgtttttgtctcttcagaggtctgagttctagctatctagggtctctcttctgagatcctaagttaccagaagcagctggtaccaattcagccaggccctcttccaagctcctactctctggttacttcaacctcttctcttttatattcccagacttagagatggtagatacttcctgcagctatctttgggttactttcctttttactattttagctctccaacatttatatatccaattctctatattaatttttttctgctaaatacctagtgtggtttctgtttaactagctggattctaactggtacactaaatgacaagcagtttaacttcatggaattctatgaggtaatatgattgcccttttatagaagaggaacatcagggtgaagaggataaattgctgcccaaagtcacatatttggtgtggaaaagaggcagaaggttaatctaaaggtcctttaccgcatgtaccatgctcccttcctgcttagaagccatgatcccaggcttcaataaatttatagacaaattacaccatcatatatgtttctggatatttacaaaattaaatgtgtatgagttgacttaatcatttaacttgattaacttaacttgatcatttaacttaaccatcaaaaagattagatattctgaaatctagttttactacgtaaaatcaaagggtaaaaaatgttagaaaggtgtaaagaaataatttaatccatccttctactattaggcaagtcttcatctaatgcttatgattaagtaaacaaaaaagaaataattagtgtgggagaagggagatgtaacattgaagaatttaattggattttattgaagtaagaagtggcagactaaacaataaatagggaaatggtacagttatattggtagaatagaaataatagctgatcagggacagaggcacggggatttcgaatcccattttgccactgactcacttggtaatatttgacaagttataaatggcctgttgttcacttctcctaaaagaaaacagaggaaagatgatatgatactaatgctctatatcataggtccattgtgaggaataactattcgaagaaattataaagtacttcaaaaatatcaaatactccataacaatacatcttaatagacagaaatgattcaaatttccaggttactataacaactaaatcctaaagtgatcctttagaaacaagacaagatgctatataaaaaaattataagaattcatttctattttcatcccacccattccaataggaaagtctgactttaaaagagtgaataaacagaaattgtgcaaacactcaggtccctcagttctctggaggccattgagctaagctttagaaaatccaatcccctgaatgttttgtccaattcacacatttccacaaagaaatccaagagctatatggagatactaagaagatagtgtctgtgaaagttttacaggagggctttaggacacttcagcagacacatagcatgctgggagggataaagtactgaactagagggagtaacttagttggcaggcagggtagtccttgcccaaaacagtagcccagaaagtaatggatagctataatctgaaccaaaatataaacagtcttaatgaaacgtaattctaaaacaaaatgtaagacccaatattcaatactactcactaggttcagaatctagtgtaattttggacagatgctgaaatcaaacaagtggcataatctgggagaattgactaacgacataaacttggatatgacagtagcatatcttgagaagcagagttgtatctagataagtttatccaagataaggcaggaaaatgtggaacctagaactcagttctgggaaacaaagctagttatttaaaggcagaaaatcaggcaccaatcaataagtcaggatagagggctttgcccctctcatgctctaaaaacctgagacccaaaagataggtaggtaagccgttagtgtctcagaggcaaatccaggggattattagattccaaaagtgtcatcaaggtgttgaaaattactaggatcaattgcttgctagtcatttcagtccgtatctccatcctcttaccgccacccccaggttgctgaggactattataagccttctctattgccctcctaccaggaatttgggggaattgcttaatgttttctgtctagactgcccttaatacgaggtcaaggggaagaagcctacagatcacaggaagatcaatttcttcaactgaactggaacctacaataaaaaggaaattgacccataggattattttataagtaaagtatatatttataaaattattaaaatatttcattatttgtcacattaaacaatactagaaacattaccttaaattagcagatattttacagataatttatacaactgacctagcgaccagcaaagaaaaaaatatatatatgtagagaacaaatgcatagaattcattaagcagagaaagatttctacctgaaaaaatgttagcaaggtcaaggaaagtgttaataaagtagagtatagaggactcactctgagccactggagaatctgtggcacagaaagatagaaggcaaatgtttcttaacaaaacagtattgtaattaacatattcatacttaactgtgtgccaagcactttataaatttttgaaaacttctcatatgataagtcctcaaagccaccctatgaaatgggtaccatgtttattctcattttacatgtgaataaactgaattaaaaagaagtgatgctactggcccaaggtcaaacagttaataaattgcggtagcgaagtttcgacccaggcaacttgattttagagtctatgttcttaaccaatacattattcagcctattcaagcgctgactccagaggggcaattctggttctaaggcaattttcttcaatacctcctcactgcatactgatgattcttgttttacggcaagttaaaacatatctatccagacaatgttcacaaaagacatgatcttttcaataattaagtttaattatctgatgtttcctttttgtaaacacagtagagcttccgaataatgctaatatttaaaactggcatttgaataataggaaaacctattaaaatgtggttttataggttgaattagtagaagttgtgaagcactctttgatctgtcttataagcaaatcatagaggagcgggacccaaatctagtgctttacaaggtcagatggaaataatgctttacccaagtaactctggccacgtaaaatagactgacagtcaatcagtgcaaattctccaaggactctaggtggccaggattcacatgccagcccaaccagtgaccacactgttagttttatgtatgattctgtgccacatgttcagagattatcagtgtcctcatttttttagatacaaacacagcctcaggataaggaatgaagtggcctgaggtcactcacacaagtggttaagagctgagctatagatttcgaaccagtcttctgacctctgttctttgacccttgacctgcttccccactcactttagtttaatgttggcaaaaagtgatgtcaaaagaggaaatgaagatttaaaacgatcagagagaactcttcttagaataggctatagcactgaaagctagatggcaaaagcactttttagcccatgatttacagaaagtctgtatttaataccatctttagtaatattgacaatttatacctaggtggttgtagttattcagtgtaaataatccactggtgtaagatttgccctctaaacttcaaaggcaacaaagaaaaaacaactgctactatgaagtatttataatttgtgtttgtttaagtcagaacacctagcagggaacacaaatcattctagttatatgaagaaaaaggaagatttaaatcaggaacttaggtgttataaaaccagtggaagccccggaggagcagcaagcaggagccatcactgaaattcttaggtataaaactatgctgcccatacagatgtgatccaaggattaggaagctgcctgtggacatcaactaagctggttgtttccttcggaaaccttgattttgattgccataggtcttcctagacattcttggatttataatctctataggccagcagaaacagcctctggaatttggtctctgcctgaagtccaccttctaagcggaactcctcctctacttctaatgaggaaatttaattaaaaggaactacttcatatgtagaatcttagctgcaagggggtctaggaaatgcagttttcaatttccagcctttgcggaataggacagtacacagaaaaaggagggagtgaatgaggaattccaatcagtcatactcagcatgatattagtgttttgtcatttaattatagtaaaaatacatcctaaacaaggttttggaaaaccaaagtgttatagtaagactccttttgttcaccgcttcttgtagcaagaaggggaaaaggatagaggaggagtaaagaaagaagacagtctgagtattatcttgggcatttcattccagttgtccagctacgtagtatggaagacaacttggaaaagagccaaaacctaaaggatggtcttttaaaattactcatttaaaaaaaaaagtttacatccctgcctggggccatactttaagcacttctcagggatttgataacctttaagattattagcaggattggtgataggaaacaagggtgggattcagagacaaatatcacccatttcatatttttcccctaaaggaaatttcatgctaagtgtaactttgactcagtcttaaatgccagctcctctacttttgtgatctttaagtaagttgcttggacttccaatactccatgattttgtatgataaagatgaaaatagcatacttataggcttttctcactattatattaactaattttggtaatgctttcattatgaatgttaaaagacagaatgaaaataataataataattcaaagttccaagaaattatcaggacctgaacaaatcgggcttatctgagtcctaattcaacatactttctatgacactccctctctaaaatgtatctctatcattatagagaatacacagtctcgagtatactgagtatatataaacagagacgtcctttcaagtgtagaataaatatgcatgtagcccctaagaaagttctaatggaaatttttgacttacagaaagagtaagccttgctaagtaattcaagtcatccacattattagtttatacaaaaaaaatagcttctcttcttccaaaaataagcctaacttcagaaagaaatcacttaatcacttgcagatttattttagaggaaaaaaaattgacttctttgtacatatggaatttgaaattgtagtcctatgtgaaccatttatattaatcttggatgattaaattcaatttattcagttaattatatttaaggggaaagcagaatcagtgtaatatattgtagacactgtaataaactaatatttgggataagaaaattttgcaagttaccgatagcatataagccaataggataagtaataaaatagacaagatttattgtcttgtcaaactagtcggaataaaagaatatccatccatccatttatttgagaaatatttattgatcatctactatgtccaggtcgatgctaagtgtttagaaaacaaaaattaacatcatggtaccatcctaaagaagttcacagttaagtagggacggcaatgggagggaaatgaaaatcaaatttaataagccataatcgtggtgttgcacctcagtttccatgcaatgcagattctgagaagcttaattatgcaggaaatttattagggggtgctctatggatcaacacccatggaggaagagaaggaagagaggtttggcacagggaaaggctagtttgccatatagtttcaacaatgtcctcaacaaatctcatggggagctctgaagccaagatcgccgttcagaattgtcctaaaccggtacaagaggtcaggtcatcatatcacctataccaacgagtgactggaatgcagtccacacctgagaaggaggtatgactttgggtaaggcagctcttcacaaacaagggaaatgcattttcggcaactgggggaatagatcctaaagtggaatctgagcaagaagcccagcgacaacaagtggtataaacacagtgcagcagggcttagctgaagggagccaactaactctgtgtgacgcagccagaaagtacaggctgggtaaaatgtaattgaagaggtatttaaactgaagcatggactatggtgatgattattttaagtaacaaagctagggaatccatcttcaggcccaggaagagcatggataaaggaatggaggtgaaagagcaaaacataatcagagaaaggtgaaaatgaatccaaatagaaattagaataaatgttaaggggaaaaaaccaagtctggaaaaagggattgggaagggatttgaaaagagccttggaaactaagacaagaaatatggactttctcctcaaaagaaatctggatctaacaagggatgtaaagggatgaagtaataggattttatttaaagaacataattctgcaaacactgagggtggatgtttggaatagagagaaaccaagggcaatgcaatgtgtttacaataacttgaacactaaactgtgataatgaatcaaaaatgcgtcctcttcacagagataaaacagtatgacatgaagtaaatgatgacgcatatattccaccaaattatcaagaaataaattagccctccctctcctacacacaaacacaacatacaacactacccaggtggcaaaaggtccttcctggttttagtaccaacatcaaataataaccagtagcactgaggaattaggtaagagcttcaaacatacaaatgcctgccagtttagtcgagaaaggaggatttgaatggtaaccaggtaaacaccgagagcaaccaacaataattgttcaactccattaaatggcaactgatttcccagatcaactgtttctcattcaatgacagtaaacaagctaacaaaactttgcagcatatgacacaagaatattctatactgaagcacaacattgataagcagaaaaaaatatttgttatataaagtatatgatacagtgaattatattgtgacttgaataaaaatccaagaaaaaatagtctttgaaatgagataaaatatgaggtagcacaacagtctgacaagaaaagtttgatggcgaagatatatttagttattcattcaataaatatttattgagcagtcttaggttggcagacctaagaggccgactctgaaataaggattcctatgcgagtgttttttttttttttttttttaaaggaagcactccaagaaaagaccagtgagggagtgggagatgtaagctcccagcttcagcctgaagtgtaaattgcacctccagtattctcacaccagtcagtctttggctaaagcccacccagagtggctatgtaaactcccaggtggttccaactctctgcgtgcatgagcaagcgaatcagttccagcagccaaagggtaattctctgaacagaggcacagacactatttaggcattagaaggaaagtgcagagtagctgagggataggcacacacaaagggtagaagggatcccaggggatctgagcacttactgtgaaatcactgtaagtgtgggtactacgactacaggggtaaacaaggcacacagtgtccctgcactagtacatcttactttgtaggctgggaaatgcgggcaataaaacaaacaaaccaaaattctaaatgggatagggatggtttacataaatacagtagaggaaattcacatgtaaaaagtaagagagaaagaaggggcatcttattttctattatggagtcaggaaaggcctctcagacaaaggaatattggctcagatacatgaagctatgtcttaatgaaattaaaacagagctaggttatataagaaaatataataaagtaaacatccagtggtagaatgaaatctgtattaaaaagaaaaaaatatcaccttcacatcaaaaacagactcttaagtatatcatagtgagttctctgggatagtgatttaatgcttgagttttaatgcattatgtgtggggacagtaaataaaccctgagatccaagaagcatgggaattcagatcaaagatccaacatatagatacagttcctaaagggacacactttcaataggtaaactagtaaaaagtggtaaagatttctgtctgtcttggtcacgactttgcatagaacaggcagacaaacaaaactctacaatgcctaaccacttgtctgcactcatgtgggcgtggggtctaaattcacactatccatatggcccaaaaaacccaagatgaaacatgaggttatttgatgctggagtgatagtgtccccgggttcctgaagaagcaatacaaattcttaatatgttatgggcacaaaagttccaagaaacatgagctcacaataaagaagaaatcagtaaatacatcaggaaaactatgaggaagaactaagagaaacagcaaagtacaaaatcaggcccacaaagattggagatttggttattatcagacttacaatataaatttgcttgatatatatataagacttacagcataacaaaagaaaaagagattatgaaaaccagcagacaggtatgaatcagtctgttaaaactttgagaaattaaaattgtggtgaggcaatatttgaaaagataacggataagaatattccaataattttattttttttaatttactgattttttttaacttttaagttcaggggtacatgtgcaggatgtacaggtttgttacacaggtaaacctgtgtcatgggggtttgttgtacagattgtttcatcacccaggtattaagcctagtatccattagttatttttcctgatcctctcctcctcccaccttccaccctccaataagcaccaatgcgtgttgttcccttccatgtgtccgtgtgttctcatcttttagttcccacttataagtgagaacatgctgtatttggttttctgttcctgtcattagtttgctaaggataatggcctccagctccaatggtattccaataattttaaaagagacaaatcctcagagttatcacttacagtaccatatcccacaatggtacttctcaatgataaaattcaagtagaagtaaagtagtcccagaacgatggcctgaagtataagaaaggactgaagaacaaataaaaaggtaaacatgctggtatactatgtaaatatttagtgtgtaaaacaacaacaataacagtagtaacctggattaggagaagttaaaaacaaccatgataaaactgaagtcctaaatacaaacatcatttaaggaacaagagacatgataggagttaatattttctaaagtccctgtttctctgaaaatgggaaaaatgataaatcaattttaaactttgataatcattacaataatgagaaagaaaaaaagcagtccctgactgctgttagctcggaggaggtctggctaacacagcaaggccatggtgttcttttgttaaaactgaacaatctcacataacaacaacaccaggcaaggccactctgtgattatgattgagcaatacaaaagcaggaccgcttcgtaatcatatctgagcgcaggaaacacatgaaccttgtccaaaccacaaacatgaccaaacattctccatcctggctaatatatatggctgctgcttctttaccaatgacagttttagcccagctcctttccttctgccttctggttaaaacatcattgtttcccaatcagcgaattggccctactttctgagagcatccaatccagacaaagcccatcctcaaaattacctaaaacaaaccaaaatcccataacaagccccacctaacactctcataactgagacacctcaccattcctcaggatatgctgtccccatcgttgccacaagaaaccaaactttgtttgaccacaggtatatccctagagatctttggttggaggacactgacagcactttaagattattaggataatcattacaaactaaaaatagactttatttccaatctagtagagagaaaaatggggaatgatgaaaaggaagagaaactaacaatccaaaaggaagtaagaaatggaaaaggaaaaagaaccagaaaaaggataaatagaacatataaaatactatagtagaaaaaatccaaatatagcagtaaccttcaccaacatcaattcattaaagtttacagacacaagataaagattatcattttacatagggaaagccttaaaataaacgattggataaagatatgaagaaaaaaacattcaaaagaaagctggcaaatctaaactagtattggataaaaatgagtataagggagaaagcagtataacgagaagtaaagtagaatttgtaagtgtgggtgaaatgttcacataaaagactgttagttatcttcagacgtgtgctctctacttcttccataattaaaagcaatgtaattttagctacacacattccagccctgaataaagatatttactagtctttcttgtggctagatgtggatgtaagcaaaagtaatgtgcgctattaacacagcaaaaggtaataaaaccatgatatttatagggaacaattaaagaaatttaaagaaactagagactatttggtacagatacaggaagaatcagggacaacaccctaactatttttaaatatgtgaaaggctggcatatggaagaggaattaagtttgttctttacggcttcaaagagtgtgtttgcaaaaataggtcaacattacaaagaggcagaattcagctaaatacaataaagatgttctgtttataaaccattacaatttctacagtaggtctgtaaattcgaagttagaatgaactactttaagggtctcaaactaggcccagagtttcttattaggaatattgtagaaggaagtcaagcatcagttgactggttctactagataacctataggctcacctccaagcttaagattctgtaactcttgctatttaatttaaactccattcttcaaaatggcatcatgatgcaacagccaaattctgatagtctctatataaatagagaacactgaagcaatttcccggaaaactcagtctctattatttttcctgtaaaagagcactttacagatgaatgagttcgatattcacatgactgagacccctttgccaatgtcattccattccaaaaatacgttatgggatatatgtagggacaataattccaaggagatcagataacatgtagtcacacatttctctgaaatgttagaattctctaataaaggatcaagatttagttaattaactgtagtaacgggttaatgattcagagggtagacaactccaagttcatttttataaggccactttatgaattgcatcaatgctaactttcttctcttatattctgatgtcatttaatatacagtacagaactaatagcatcccttccaccctccactgtgggactgagaatttttttaaaaaagataagccactaataatgagaaaagatacagttgggaaatgattagaagcactgtgcttgtctttattactgctttatttggaatatcaacttttttcgtcttccttctcttcaaaacaaatgaaacctctgtccatgtgcaaaagccgtctacataaatatgaactattaaaaatcttacattcaatacttcccatgttttgaccacaactcaacttggttttccaataggtctcaataaaagtttgttgaatgatttagcatgcccacactctatttttcatcatgtgaatgttccaggtctaatcttgaccagtttattttgaatgattggacaaaaatattacagatatacttacgaaccagatatcatttgttgattctaggcagtattcccacccctctataactctttcctataccacttggggataaagtctggaaactacatttcccagattccattgccagcagggttttagctagaacctaccaatgagaggcagctgcaagagattcacattgcactagacatggagagcataatttttctctggcaactgcactgaggaacatgggcaccagcagatggtaaatttcctgaaatccatccccctgacttttactccctcagccttcaacaattgtgtgagcctctaatttccaatattaaacttcttcctgctggaaatacctagagaagctgctgttttcctgaccaagcctgagccaacgatctaagaggcatgcataatcaagaacaagaaaggtaaataacagtatccaccagtgctttttaaaagagtcttgacagcagtgacttgtagtcagagctgaattttgacaattggattaaatattgagattcagaaacatgggactggtaatagaacagctgagcaaactctgttgaacctcttccttgctgccaagacaaaacagacacaaatagacagattctgcaatatgattagcggaacttttcaagttataaaaaatggatcatcataaatattccaaaaacctagacaagatgtcagacccctttcaaataaatgcgatcacaaacaagatgataaattaggcaaatgttgagcttaacagcctaagtcactgccaaaagttaggcttattcctataacaaaagactctggtggctatgttaacggatgactcccttgctattatttcatttcaaggatttaattatttgcatcctctcagatttcaggaaatgccaactatttttagatgctgcaaatgttactgaacatgggtccctgagagcttgggcaatatactcaaattttccttaatatacgcattcacagaaacaagtcaactcctcaactcaacaagtcaactccacagactcctggcttgtggagtttttctgcacacacacaaaagaacattttaagcttttagagctttcaatcagaaaaagatataaaaatcacttggtactagagtaattttaaaatctacgtagactctaagccatctttctaatgcagagtttccatcccacgtcataccaaatgtattataatacactcatatcccacagttattataaatgttttgctatataatatttagaggagttttataattttagttttgatattattcacacttgtatcattaatttattattggttgcaatatctcatcaatcacgctgcatattggagaactgtatcaaatcaaatttcagtagttttcaaatgtagttaagttttcgaagactgccaaaagttaacagttaataaacttaacttgatagcacatcttggagatattcactgaaatggaacttttgactttgcagtttttatttttatattttagagccaataatattttttttcgtatctcagacatttcagaagcctttaataacctgcttagcataagacatgggaccatcaataaacaatctgcagcttgggctgagagcataaattcacatggtcatctaactaacaactgagaagtcaggttctcttcttcccactagaaaaagggataagaggaaattgatttgtctgtccctctttctttgcaatctatttagaaatccacctagcctctgatattgtcctgaaatcaatgtctccactcccacatctcacagggcagaggtgccctccctcctacctggctactacgtgaatccctggcatcttctggccacctcctaccaggcatcagagcttcactgagcccagtttggctaatgagaagttggaagacatcaacaagggtctagagttcagaacactgtcactattcagatggaagcacctagttaaactgacagtcctcctggctgacaccacaagcctttttctgccatttcactaactttctgagagagcaggtgtttttatcattgtcttccagtgtagacaaattggtttcatcacctaataatcatcgcttttataagaggaatgtctggatggagatcagtttcaatgataaatgttattcttctccatctatttattcatctttctagcacaatagcagctaacaggagtctctcctcttatgagagggaacttttatcaaaaagctactttgtgcctggcactgtgctacatgcatcatatacattcaaatatagttataaaatgcaattaactaagtactttcattgtccctatacataaaagcaaaacaaagttatcagctcacaagtagccattttctattcctttgttatgaatccaaaccctcttgatatcaaacccatctatgtcccactacatcacccactacccctgtttagaaagcactttcaaatgcattatctctttttacaacaaacataagcccatcattttaaaggaattgggagttgtaattaaagtattaatttttaatgaactattttcaatgttctgatataaaaggtattgcatgaactccacgagaccatccattacaaatctttaggccgatagactacatttcagagttatttccttcctgaacctgctttagtcagatacagaggacatttcaatagtttgaaccaaataaaaatgttttgctattattcagtaagtcaaggtattataatggcctcatgaactattccaaagatagcagcattaccatactgtagatgctatatgagaaacaaagaaacagacttgatgaagtctattttaaaatcattattagttgatgaaaccaatttgtgctaccctggaaggcaattatcaagaaggctgctccctcagaaaggtgatgaaatagcaaaaaaggccaatggtgtcagcaaggagggccatccgcttaacaattatatatttcttactaatataattttattatatatatttttatataagaatatattttaaatggttacatataataaaaaaaatcaggctaacatcagacgtatctacaaacagtaaaagacaagcaatttctagtaagttttatgaaaaatatgatttcaaattttatagccaagtaaatgttgacttatgggtaagggcatcaaaaagtgtttgcaagtgttgaaaggcagacaacatgtaatattcatgtgttgtttctgaataaaatatttttgtttttttcaaacttactgaaattaaatgaaaaataaaagatcaagaaggaaaaggacacggaataaagcatttgaaaatgaacatcaaagccagttaatagagaaatgtataaataattgtttataatagaattataaattagaactcaaacgttacaagtaactcttcaaggaaaatatcttaattgtcaaaatatattataacaataatataacactgaaaatacatttaacaagaccaagaaggaaagaggtaaataaatagggaaagtgaaacatgttaagtcttgtctcaaagacagaggaatgaaatgccaaaaatttaatttcaccatgacagatacatagaagaagtgttaaggaatgattttgaaataaagttaactagtagaaaaattatacttaaaataatttacaacttaatttttacacaaaatagtatccaaagcaaaacatatataataagaaaaaaacattttagaatggaaaagtttacagtttataatgttataaatatcacgaaccttcactggaaattgtgactcagagctctgtatgtgtctgtatagaacatataaactggccacctttactgtataagaaagacaagtatgtaaaagagaaatcattgtcagtcttacgaacctccacgtgctagagttggggaagattttacttatgggtcagcaatatgcaccctggaagccccagatattttggtctacagcattagagacaagacttccgacgtttgaattctaactcctcctttttccagcaactacctttcattacaacaaatacaagcccctgctcccaaaatgcgttaagcccccatcccctaaataaatacatatgtactgaggtaaactaaaatggtcccctatttgtcttgtccttcatcgtgtgtgtgtgtgtgtgtgtgtgtgtgtgtgtgtgtgtgtgtgtgtgtgtgtgtgtttgtatccaggaggacagatgggtaaagaagcttcagttgttcttcaattaatcttccaatttcatccccacttttcacttctgccctctactctgtctgctaatcctctggagcccctgtagagcatgtaggtagtatttataagtagacctgctcccatctgctttctaattcccagagatttgctgaaatttctcatcctttactgggactctctttgccaccatgtcattattattttcatgattgattgattttttattgttgtagggttgtctcaggagaaagaggatgcaaatgtacgtgcttaggtcaccatcttgaacctgaagaaacttacagtgctcttagaagatatctcttgtgatgaggaaagtttacttgtttgtttttaatccgaggttaagatttcaatcaggtggacttatcttttttaaaaattcaggtaaattaaattacttttaatgtaaaactacctgtacaattaatcccaatgtgattcagtcctttcctccctcccaggctccctttcttctttccttccttcatgtttctttctctctatctgtattgccatctatgtatctaatctatgtagatagaaaaatattaggggttagaatttttgccccgagtattaggattttagtttgttatttctagtttttcttatcttaaaatgattatggtcagatacagtggctcacaactataatcccagctacttgggaggctgaggtaggaggatcacttgaggccaggcatttgagaccagcctggacaatacagtgaggcctcgtctcaaaaaagattatgcatatattcaattaaatattgaaatagttattaatataaaaaatccataaataccctcttgactggcaatttaacttagcaatttgtcataaataatagtaaaataactcttcaaggatgtgcacaagcacatttgtggcaattctctttatgatcaaaaaacatcaatagagaattgattaaactgtggtagagttaatcaatggaatattatgcagtcactgaacatgatcatctaatcatatatattggcaaaatacggtgaaaaggcctatactagtttgtttttcagtgtttgtattacatatgcttaagaaaaagtctagaattataaataccaaaacttcagtagacgtactatctgggtgatagtttggttttctcgcttatgtttgccctatttttttatctttatctttttttttttttttttttacaataggcatgtgttactcatatactcagagagtaagcatatttctggtttgaaagagagagagaaagaaagaagcgggtggggagaacacaaacacattcatgcacgctgggataaaataacaatatttatgacagtaatcaatactactttaaaagatgctggaatttttgtatttttcttcataatatacctcgaatatttgaatatttgaatattttaaaactacctttataaaatcctctcttcctactatttttcttgccattctttttcccctagcagtacagccatcactaaacatattccacctatttgatgacagttaaaagtacatagaaacatcttacattttttgttatactgagtatatatcaaatgtttttaaaaataacatttcttgtggtgatgatagcctccacaaaacaagcaaattgtactgatccacagcaatcatacttttcattaaattgcaaacatttcatataatctcagcattcaaactaattcaagtagatttggtgaatattcttctctggaccccattaccagacactagttctatttctacttttgtgtcagattgcttgtcttacacacactttcctcaatgacattagcaatatcacagatgttaataagctttttacagataatctcaatttctctcatatttgatgccataagtttctttgaatgattttatacatgtattttcatcatgatttggttatcttggcttaaacagtaaaggatgtctgcaaaatcctagaattccatagaacagagtttgatagcaatttctctaaaggctcccaaatatatttttcatagttttctaatttctgtaataaataattgtcagaggtccactctttctctatgtcttcaggaggatattgtctttcacatttgttttggcaacttcttttctgtaagtcccagctgttttatttatctttcccatttatttagaggatctgtagtttttctttggccatcaatctgtctgctcgggtactagtcaaatttctatcttatatctatagatgaaatggtaaattggtgatatccacagtccttcatctagcaacctttttgcagtccttttgtggttactgaaacacactctctattgtcctcactcccttgcatctttaagaagaaggaataaataataatgaattgataataataaactaaaaattttaacatatgctgtcactggagaactcttatttcagacctatctttgtccgtttagactgtatttccacagacgtgtttgtcacggccacctcccccccttgctattcaattattctcttggagttataggattataaagagatataggaagaaaagtactaacaggaatggggagcagtgaaaggcattcacaccagcctacaaaagtgcagccactctatagaatggcatcctcatttctgattaatacaatccttgagcttctgggcagcagatgtgtgggaagggagattcagattctacccagagtcaaggggtctttctacctacctgctcttcatgaccagaattctgctctacctttctagaattgcctcccaccatcactccctctcaaatgctccctggcccaattagcttgaaccacatgtccttcctctaatatcctatttcctgctaaaggagctcagggaaggcttttctcttgtttaccattatattccccgcactgaagtttgcctggtatatagtaatagctccacaaatatttctgaagcaataaatgaacacttctatgccttttctcttgtctatttttcctttactaccctttccctcacttttctgtgagacaggagccttctctttatcaaaattagcttgtgccatctcctgtgaagatcatacggaacatctccaaacaatgttaggtgttttctcatctattataatatatatcgtagtattataattgttcacttgcaaatctaatttacccactagcctatcagcctgagggcagtaacaatattaattttatctttatgaccccaagcatgatgatacttagtaagtgcttaataaccaattgccggatgaagtcttctaaaccaaaatttattgttctttgatactaataacaataaaataataagtgtttactgtgacatgtggttaaaagccagacaagcagagactgaatcccagctctgacccttacaaagtgttatcttcttgggcatcttgtctagtctctgttactcatttttctcatctgtaaaagggagatgataataatagtacctgcctgatataattgaattaactaacatatagaaaggtattaggatagtgtctgccatctagaaaacattcaatatcgattagctatactgttatatactcacaatgtaacagatcctatgtaaggtactttaccataaaaatttgttcctcacagcaatgctaaaggtattatttcaaagatcataagactaaagcaaagagatattaatcgatttgctcaagatgacagaattattgtgttaaaatctgcctactacctaacttcacaccacacaaatttctacaagatcttgaacatgcatctgagtctacattctatgagtcacaaattattctatttctttgaaaaatcttgtttcatctccaccatatgtaatgtacaggctgcaaagcattatatttgagagctggctggggtgctacagtcagactaaccgaggttctaatcctggcctgaacgttttactagctagtgatcttagcaagtttctgaacctctctacgcctgaggttccttttggtaaattgagcataataatatcaacccccaaagattatttattctgaggatcaaatgagattaaatatgtgtaacatgcttagcaaaatgcctggtgcactcaaagttcaataaaagtaagttgtcatctacccctgttgtcgacctcatttatttcattagtttctgattgcattttagaacttttgcatctcatttacaaattctgggggtttaccttctttttcagagtatttctctgaacaccaccacctccctcttaggctaagttaggtatgccttttcctattccctcgcaggatgtgaaatataccgctattttctgaacagcagcagatgggaaatgatccctggattctccccttatggatgacaagggaaagagagaaaaaacctattttaaaaaacaacatccaactgcataataaagtatctatgaaccattccattatcttgatctatgtgtgtccccagaactcaggctgcttgctctaggaaagatggtaccagcaccactcagtctcaatatgcagcaacaccatcagatagcaatgtgttgatgaacatgtaataatagtcaactctccaggaaaaaaaaagtccgaatttgtagactgccaatttctgtggtgtaaatgttccgaccctggccaatttcaagttaccagcattatatcactgaatatggagttgggaagagacgtgcaatagcaccccttatgtagtatttctaccatacacagaaaacagatgtaaataacctcaagatcatggataatagtaaaatgaagtcagataactaggacttaatgagttgtgagtattaattccatttttataaaataatgtattaattatgtctatataatttcattcttgttggctgtgcttaaaagcctgctcccaaaactcctgataatgtagcagtgtctctcaaaagctggtacaagctgaccccagcacaccaatgcctttggaggtaagaatgaagcatcctggacagaggaagattgaagcttatataatgtagggccttcgttaagaaaaaatatgatgcttaattagatttttaaaaactaaaatataatatatttaaaaaacatattttaaaatgtttaaaaaataaaaatatatttaaaataaaaaataaatatttatctagaagtgaattcattgagaagagaatattttaaatacccacagccactccagcacccctaacaggaagggacgtgtggggaatgaactcagaatggaaagagacagcagcattaaccagctgtacctaaaatatctgacttttgcaaatgtttcaaaaacatatgatttatgtcaaactgttgctagaacttttcccagggacttgaggctcacacaagaaatgagcacaggccgggcatggtagctaacgcctgtaatcccagcactttgggaggctgaggcgggtggatcacgacaaagtcaggagttcgagaccagcctggcgaacatggtgaaaccctgtatctgctaaaaatacaaaaatcagccgatgcagtggtggtgggcgcctgtagtcccagctactcgggaggctgaggcaggagaattgcttaaacctggcaggcagaggttgccagtgagccaagatcgtgccactgcactccaacctgggtgacagagcaagactccagctcagggaaaaaaaaaaaaaaaaatggaagaaagaaatgagcacgatggtaagcctatctctgactctgagcaatcaggactgagctacttcagttatttaggtatcagtgagggtactatataccctggtaagttatgaacctctggagaaccttagaaacagcaggctgcaaactgatctatttacaggaaccaacaggtcacgtgaatgcctgaagtaggtctgtgggagcttgtagctaataaaggggcacattttttgttgaaagcgagtgccagctgctaagctcagggtgctttttgtcatggtgtactatgggcccagtattaccaaatattctgatatttcagtagaaaccagaaatctggaattttatgtaaaatctcctgacttttaaatgctggcaagtaatacaattaaaaaaaaaaaaatcctgaaggtcaaacaaaactggggctgccaattttcagactccgccttagataatgaagaataaataaataatgagtgcattcctttgtttacatctttcaccctgtctatctcccacctcttactcctgggagctggggaaataaacactataataacaattattaggcagtaccataattgcttgtcagtggatttgtctctcaattagatcatgtattcttggaggtcacggctaacatgtttttctctttgtattcctagtgcacagaatacctggcagatagcatctgactcattgagctgcacatagcaccaagtattgcagatagagtcagggtagcatagaggtaatgaatgtgagctccaggaccaaattgcctgagtcagaattccggcaactatatttatgtgtcacgtatctttggacaaatgtctttacctctctacagctcagtttcatcatgtacaaaatgaaaagtatcatcaagtatcacacatagagtcagggtagtatagaggtttgtttctaaacacaaatattatccataatgttattattactaatatagtaggttttcaataaatatttgttgatttatgcttttcaacttttaatggtattagttatttgtaattattaatttttatttagaattacatactggccctaaagtgtctaatgtaaattggcagagataactttatttggattaaactgtggcttccataagcttgacctaaataaaagcctggaactataaaagccattctcacaggacacatctgtggctccttttaaattgactacttctctgattaatctgagacgtgatcaaaatttccttataaagactttgagccaaaaagtgaaacaactctttgtcctgtgaaggaaagttacggattagaacggaaagcggttttctcattttttgtaatacatctttctaccccaccaggctaagtttcacatcatcaggtactaaatcgtattcccattcttaagacctagcgtgatgtttgtcatgcaatagctcttattaagcttttgatataaaataaagagaaaccccagtttccatttcccactgaaaagagcctttggggaggagaaagtgagttaatatttattgagctcttaatgtgggtcatatcgtttgctagatatgtaacaaaaagtcatttgaatccttaccaaaaccctgatttataatccttcttttgcaaaagggagactgaaactgagagaggtcacatgaattactcaagtctgcattataaacaattaaggagccagtatgcttccaaatccaaagtctatgctctttccaccaacgtatttgactgtattttaatactaactctggactgaacatttttacagatcaacaactgtattaaaagaaaacaaattattaagagtatcggcaagttaattacaaaaataatcagtggcactattttaaatttgcattaatgttacttaagacagttatggttcatctctgttgaaaaacattgaaatgtgtcagagaatcaattaggagcatctgctacttataacaaacttaaaacattttatgtctaagtcagatacggatgattttagattacgtcagaaaatgtgtgttggatttcaatggctggaacataaaacataactgtgggaacattctgggattttttgaaatacaagtctgtcatgtcatctccttgctcccccgtttccctgccccagtggcttccacacttcttaatagatgttttaatgttctccaaaggtttgaatttgagcccatctctgcatctcatgtcttaccttatctctccttcaaaatctcaccccaggcctaactgaaattccttcagtaagtcatgctctctcctgcttcaggacctttacacatgttgcccttctgctccccgactttaatcaattgacccatcctcatccttcaagtcatctcagacaaaatatccccaccaagcaagactttcagaagcccaagggtcagggttgggtgctcagacatgttcctccatatctggttatctcttcccagcatacccttcatctcactttgtggttatcgtcaaatgatctgtttccttccttccttcctttctcaatggagggtgagaactacattgctcaccagtggctctccagtatctcctaaaatatctagcacacagtatgtgcaacctatgcatctgttggtataatttcatggatacataagtaaaatatggtgacttcacaattaagaaaaatagcaggtatctgtataatattaacatatgattactgatgttaatggtaggtttattccagatagtaaaatataagcagattaaaatcttagttacagatttacaggacgggaaaaggccttagaaaatcaccaagtttaacttggttttccaaaaatggaagctggggctgaagaagtagaataattgagcctgattgcatggcctcttagaccatcaacaaatatgtattcactggacatctaatagatggctattaagcactccactaggcactggcaggtgaggggagaggagaccagccaagaacaaaattcctgccacagagataatacagtctagttggagaaacaagaccttcatatgtcaaacaattaaaggacaaagagaaactatgttattaagtgctaaattaggcagaagagacaataaatgctatagccattcaaaatataggaaagataaacaaccaaatgagctcagattgatcacttactgcctcgtgactcctcttggaattcctccttgttttgatgactgactgtctcccatgtcatgaccagccctttagggaaagggatatttttgttgctctcatacttccttatcatggataattaattatcagttgaaggaaactgacttatgctgtcacttgggttttggaaaagaatccttcaaaaatcacaatattctcttctagtcaatgatgttaagatttcatcaaaataaatgaataaaatatagcattaatattttatcacacaccccctgcaggcctatgcatcttaaaaaaaaaaaaaaaaaaaaaacagcaactggctgcttttgtctacttaactaatacatcgctctttagaattgtgacctcaagttcccttgcaaatttcgtctacctgatcctccaattataacatctcactatcctcagtaagcttcagaaattatgaaattacataatttcatatcactatcctcagtaagcttcagaaattatgaaattacatatatatgtatatatatatatgtatatatgtatatatatgtatatatatatatgtgtgtgtgtgtatatatatatatatacatattcttgatcatccctttaatttaccaggaatcttctaggagttcctatcacttccagaagctggggtaggtgagggaggaccagggagataacaggctatattttccctatgaatatgtgatttcttcatactccacaatgtctcaaagccaaggaagaaaatgatcaatactctcaatattcaatactgtcgcttaaactcaatatcttgttcttttcaaacatcctaatcttcccaggcagaattagtcaccccacgctctgtacacctgcagttctctatggaaatatcccaagatatttcacatagagctgaactgtaacgatttatcactgagtttttcctttgttaacgtatattttcttgaaagcagatctctgcagtgtactttttactccaactaactgcccgacacatagtagaccccaaacatgtttggcatgaatgaagacagccgtcatttgagtttaattttcattaaatgtgcttaattcttaagcaacttttttaacagtggtccgagctaattggttttctgacataggcagtctcatttcgaatggatcatattccttttcaggaaagtatattttaaaggtactataacatgggtatttaaacagagataaaatgagagttctaaaattatgagccctaggccaccagagaatatagtacaaatttatagagtgaaccaggttttatcaaagctttcccttggaaaatactggctcgctttcctcctggaaggctctgctctgctcagtggcctggtatcctgaacattgacttgacctgttttgaggtgttagtctgaccctgaagtttaaccaataaaatattcatgacctcctctaaggtacatagatttttattagttttatatggtatatacacactatgtagaaaaaaaatacaacggcatgattcagatggattggcaccttatggtgactgggccaataaacagagaatgcagtttaatgtagacaaatgtaaaataataagtctagagacaatgaaccaaaacagaaagtctgtattaagccatagcaatgcaatgcagtgatcaggaaaatgatttggggatttttgaatgataatgctagaagccagaagatcagaattgtttgctagctgagcaataggcttatgtgatgcacagaatacaaatcaaattatatggtggcaatacagtgaaaacaacagagcatgtgactctgtcaccatttcaacacagagaattaagcacaaccaacttcaagttggttggttacagagaactacggcagctaaatatatttaagtcagatattaggaaaagcttcctgcctcagtgggctgtgaaacattaaaattacttaaaaggacaatagcagtatctcatttttatgtgacctttttccatttttagtgttttcacactaacaaccttatttgctcctcaccataaagctgtggagtgcataggagaaatagaatttccattttacagagagttaaactgagattcagttgccaaggattataacaaagacaggataggaccctagagtttataaatatcattctagtgctctttaccatgacatgtcttctctaggcattgccaagggaaaatttggagtcgagctttcaacagatctttaagaatcatatagaaagttatactgcctctaagaaagcagaagactgatttcatgtttagatacaccatcccacaaggattgtgtaattcagcatgctaagttacacactttgagaccagaagagttgaaatgtcctaactattcagagcaagcatagcagtatattccacagatggccaccacaatgtctcccatcacaggtgcttcttcaaaatgtgaccttaacattattcctatccagagatagggtatctctcctgtccttttgaatgtgggtgggcttgtgacttgtttgtaaccaacagaatgaggtggaagtgacactgagtgtgggtcacagaaggcaatgtaatttctgtctcatcaactggaatgttctctcttgactacttcaaccaccatgaggctgctgtgctgtaaggaagcccagactagctcatgaatagaaaccacataaagaaaactgaggctacaagaagagaaaggttcccaggaaggcccaagatgcttcagccccttactattccagctccatgtcactgcaaatatagagagagctggggccaaaaccacccaaccaagtccttcctcaatttcctgacccacatgagaaataatgaaattatttttgttatgttaagctattaagtttaagagtgatttattattatgatttcaattgttttggggcgaacaggtggtgtttggttacttggacacattctttagtgatgatttctgagattctggtgaacccatcacccaagcagtatccatggctagaagactcgaagacagatcacatcacaggactccgcggacattcctcagcatcagtccagagcccggtagccctgctgggtgaccagacccagtaaggcaataacaatcactgcaattcggctctcaggaagccccatctctaggggaagcgggagagcaccacatcaagggaccaccccgtgggacaaaagaatctgaacagcagcccgtgagttccaggcctttccactggaacagtctacccaaacgagaaagaaccagaaaagtaattctggtaataggacaaaacgaggttctacaacactcccaaaagagctccccagcaatggatccaaaccaagaagaaatctctgaattgccagataaagaattcagatggttgattagtaagctactcaaggaggtaccaaagaaaggagaaaaacaacttaaaggaattaaaaaaaaaaaaaaggatatggatgaaaaagtcttcagaaaaatggatatcattaagagtgatttgttatggatcaataataactggaacagaatgcgaatgttctcaagagtgtaggcatttggggtctttttgtgtttgttttgaggcagggtctcactctgtcacctaggctggagagcagtggcccaatcttggctcactgcagccttgacctcccccggctcaagcatgcctcagcctcccgagtagccaggactacaggtgcacacaaccatgcctggctaatttttgtattttttacagagacggtgtttcaccatgtcgcccaggatggtctggaactcctgggctcaagtgatctccctgcctcagcctcccaaagtgctgggattacaggcatgagccaccgtacccagcctgttttttgttattttgtttttattttaaaatggtacccagcatctcctctcccttcctaatagcactgtgatttccctaagaaattagccatagcccctttctcccagccaaggagaatactccctcactggaattttactctttaaccgaatgataacgctgtaagtccattatcccattactctagcctgaaaatggcaggaggtagtcatcaagcatcacaggcactctaaccaaatggtaccaggtatgaggtagtcctctccttcctgttttctgggtctttgaaattgtcttttattctgctccattccaggtcttggtcttcagccttcctaacagtcctataaattccccttatccatttaataaattccttttaatttaattgagaccaagtcactttctgtaatttataaccaatgatccctgactaatacggtgtctcgtccaggaaataatgtttttataactttcacgacctgtccttgacacgcaataaactgcacatatttaaagtgagtatctgacaaattttggcatacgtatatattcgtgaagctgtcactacaaaggagggtattgaacatacccatcacctccatatctttccttacgtccctttgtaatccttccattctgcccctctgtaacccctatccccaagcaccaataatctgcaattttttcactagagatcagttttcattttctggaattttatataaatgaaatcataaactatgaactcttattttcctctgccttctttcactcagcacaagtattatgagattcatataagttgtgtgtattccattgtatagatataccaaagtttgtttatctgtgcacgtgttgatggacaacggggttattttcagattttggctactatgtcgaatactgttaggaaaattcatgtataagtctatgtgtgttatacgcttttatttcactagataaatacctagaagtgaaatgtctggattatattgtaggtacatgtttaactttttaagatgccaccagtgttttccaaagtagttatattgttctatgtttccaccagcagtgtatgagttcctgttgccctatatccttagcaatggtagacttttcactttgggccattctaatggttgtgtcatgatatctcattgtaattttaatttgcattttcctcgtgattaacgattttcagcatcttttcatttgcttatttgttaggtcttataaggcttccctttttcttaacctttattttaggttcaggggtatatgtgaaggttggttacataggtaaactcatgtcacggggtttgttatatagattatttcatcacccaggtattaaacccagtacccaatggttatattttctgcttaatgtaggttcatcatgcaaatagatttctggtgagccacctacaaatttatcgcacctgcctgactccaaacaatgggtatagcttcggtttaaaccacaacctgttacatatctacataaggcaacacataggaaaagacaaagaagatacaccaaaaatggtaaattattacctctgggtgttgggatcataggtgagtcttttcttcctgcttcttgaaacttttctgttttctgaatgcttatagtgagcaggtattgttgttggcctttggggaaaataattaaatgggagtaaatgtagtcatactccttggatataccaatatcccaacagcagccatgttcttgttccttcttccacgaagaaaccaagtagagaataaccattcggtagccaattcttactcatttccatggccagtcacctccaatgagggcaacatttggcagagtatactgttctcccagagaattgggtcatgggtgtggggttcaggaattcaacaaatagaagagctgaaattagatgaagtttagatgagacttggcaacaccaactcctccatgcagaagagttttcatagtctgcagatgctaataaaacttaaaaagtatggcaacaaggaactgatctggagcctaactgagaggcatgcatgcagtatgtgtgctgcaggcatgtctcaataaagaggtaacattattctctactaccaatatttttaaaagtcttctagaactagtgtttgaaaggtgctagccttgaagatcacccataatatttcacacatacttagctaaatattgaacagactaactctctaaaggaatctccagtaattttgacccaaagctgcacatggcggcaggcatttgactccctttgttttacaagcaggggtttcaaggaaaagttctctcttctccacaccccagagagcctatagtttgattcttaccccaaaaggggagatggattgatgaagttcagatttcttactaatgaggctaatgtgctctaagatggatatgaaattgtctaagataaaattgtgaactacttttctacttggtgtcacttggattatgaagggaaaaaatagttgtatgaccaaaactgaaaaatgatttatttacaacccaggtacacagaattggattcattacaacctttacttcatggcatattcacatgattgacctatccatggccaacttatatttggtttaacagtattttaattatttcctattgcgtaataaaatgggaacccactacctattcttaaaacaattcttaaaacaattttgacatgtatccagaaatatgcaaatgtcatgatctcccaatgttgagaattacaacaacctgctgagttaagaacaacaactggtgttgggagataaaggtcataggtcaaatttagggagtggaatttattatataggcaaagaaaaatcagtaaatctagtccaagaacacagacatggctagacgtataaaatgagtagttaaggctgggaacgatggctcatgcctgtaatcccagcagtttgggaggccgacgcgagtagatcacttgaggtcaggagttcaggaccagcctggccagcacggtgaaaccccacctctactaaaaaatacaaaaattagccaggtgtggtggcaggcacctgtagtcccagctactcgggaggctgaggcaggagaattgtttgaacccgggaggtggaggttgcggtgagccgagatcgcgccactgcactccagcctgggcgacagagcaaaactccgtctggaaaaagaaaaaaaaaatgagtagttaaaaaaaaaaaatcagcatacgacttatgtttagaaggcccttcagacccagatacactagcattagtgatatctgcagataagagatatgcatgtgagtatgaatccaagagagttgttgctttggagaccaaatctggcacaccattgcagcctatatgagaacctgggtcagcagacgtattaccctggagtaaacaggatgtcacaggacaatgcttcatataatactctatggcagcaaaaggtaacaggagtggagagaccatttctcctcccatctagaacggatggaggactgagttcctgcccctaaaagtgaggtaagccattagtttttggacaatttagagataaaggacaacactaaattaggagatacattggcagtaataatacttgtgggtctatagaaataagttagaaacattaatgagatatgaatcaatttattaagccctaagtagctgcaatggactgaatgtttatgtcctcccaaaattcatgttaaaatcctaaccctgaatgtaatagtattagaagatggagactttgcgggagtgattaggtcatgagggtaaaacccttaagaacgggattagtgttcttataaaaggggccccagagagatccctctcctcttccaccatgtgtaaggttactctgggaagacatctatgaggaattgggccctcaccagacactgaatctgccagtgccttgatcttggacttctcagcctccagaactgtgagataaatttctgttgtttataaagcaaccattccatagtacttatgtacttaggtacttacggcaacctaagttagactaagacagtagttacaagaaggcatagcataggtggaattaccagcacaatgcaaacagagcacaaatacctcagcatagtgctaaggctcttcataaaaaaatacttcctaacaaaatagaccagctttcgtagtacttggtaaagccacaattgtgcaagcttcagtccctacgtcccaaagcccaagtcaaagtctcaaagactacatttctccataataagctcaagcaggagccacaggaaaaaagcagggtaattttaagactggtttaaaggaagcaacctgtccatgtggtgtgtgcctatgtgtgtctgtgtgtgggttggtggacagcattgaccagcagtctaaagtgcagtgttcaaaagtactatgttagtgatttcatgtaacatatatatatccagggagggtgaactgagtgtggtagaagacagaagaagaatgagatttcaaaccaagcatagaaataaatttagtttgacatgctgggtgcacacagtgagattggaagggggttgggaatagggaaaaggaagcagatcagtgagcatgcagtgcccggagctcacaccagacacggtagagttcatgttcacagtaattccagacatcaataactagtggatgtgatgttaatataagctgctttccttggtcaagactggatagaaaaataaactggctgagtgtgccagttgaagacatcagtgacttctacagaaagggtcagggaaagcagatgctgacattctctaaccaggtttattcattcatgtattcccctttttactttttaaatataaattctaatatctgcaaagtacagtgctaggtggataaagaaatgaataaggcatgattattgcactcaagagctttgaatacagttatctctcacgtacctgagtcactaaaaaacccaaattaaggttttatgagaataatatgacaaacataccaccaaagccgtgaggcagaaaagagcccttctattcagaggtgggaacgtgggaaatcaatgaagaattcagggcaacagcatttgaactaaggcttcaaggatgaatcaaaagagaaaaggggaagaagaactgacatgtatagaaagaacagggcataaggagggacaaaaaggctggaaagtgcatggtatgttagagaaaagttctcacactttaatgtgcctacgaatcaactggggaatattgttaaaatgcaaactggattcagttgggcctatgtgtggggcctgaaatcctgtatttctagcaagatcccagggaatgccaatgctacaggtccatgacaggccaccctttctgtggcaaggtgatagagaaaatgtatacaaatatgaccacactgaagggcacagagatttagagtgtgtaataaggttgataacagaggttgagattgggtcatgggtagcctacaatatcatgctaaggaatgtaaaggttattacagtaagtcccggacaagcacttaaatagtgagtagtttcccttgattcatcaatatcttcttcacattgttgacagaagtatcctttttatagtaaaaatatgatctggccattcatcttcataaaaccctttggatttaaagaatgctggagaaaaaaaagtatccaatgattacggtcgcttgcttgagtgactgggccaaaaagtgatgtagttgactgggattggaagcaaggattgagagagaaaaggctgggcagggagtaggaaaagagagagggagaaagaaaggaaattaattcacatcctcaaagttcagtggttctcaaccatgacttgacattggaatccacatggtggattttaaaagtattgatgcttggatatcacctgcagagcttctgctgtaattggtatggggaatgaactacgtatcaagatgtcttaaagttcttgcagtgattctaatgtgcatccaaggttgatgaccacaatcttagcatccccaaaatattaggcatcttgaaaatgattctctcattttattttcactgtaacttggtatagaaacctatctcaaaaggggctcccactgaccaaatatggcacaatttgaacctcaagagaatactactaaaatgcattgaaacacatcaaacatcttctaaaaaattctatgtattcatgaagtttcttttggagatgatggaaatgttctaaaattaaactgtggtgatggtgccacaactctgtaaatatactaaaaaccattgaagtgtacattttaaaggggttaattttatggtatacaaattagatttcagtaaagctgttaaaaacaacccaggtattcatatggtaatttttttattattattacactttaagttctgggatacatgtgcaggatgtgcaggtttgttacacaggtatacatgtgccatggtggtttgctgcacccatcaacccatcatctacattaggtatttctcctaatgctatccctcccccagctccccacgccccaacaggccccagtgtgtgatgttcccctccctgtgtccatgtgttctcattgttcaactcccacttatgagtgagaacatatggcatttggttttctgttcttgtgttagtttgctgagaatgatggtttccagcgtcacccatgtccctacaaaggacgtgaactcatcctttcttatggctgcatagaattccatagtgtatatgtgccacattttctttatccagtctatcattgacgggcatttgggttggttccaagtcttttctattgtgaacagtgccgcaataaacatacacgtgcatgtgtctttacagtagaatgatttataatcctttgggtatatacccagtaatgggattgctgggtcaaatggtatttcgggttctagatccttgaggaatcggcacactgtcttccacaatggttgaacaatttacactcccaccaacagtgtaaaaccattcctatctctccacatcctctccagcatctgttgtttcctgacttcttaatgatcaccattctaactggtttgagatggtatctcattgtggttttgatctgcatttctctaatgaccagtgatgatgagctttttttcatatatttgttggctgcataaatgtcttcttttgagaagtgtctgttcatatccttcacccactttttgatgaatttctaaaactcagtggtcatctttggaggtgttagtgaacctactcactgttctgaaactggcagctaaagggaaagaatcaagcatttgccctgcttttctgtcacaaaactatacatcaaagttaccaaacaattcatgaaaaaaaatctcatttataagaaaaatttcagctaataaatgaaaaagaatgatggatttgagtgagcaactgtgaaagtacttataaaacaatcaggcaaatctgaacactaactggatatttgatgatatttgactcagccacataacaacttgggtgtatgaattcacctctctgcaactcggtttctttatcggtaaaatgcttataacaatgataactcgcttataagatttttgtgaaaattatctaagttaatgtgtttaaaaggcttaaagtagtgcctggcacatagcaagcattctatttgctattgccactactatcattgatattatcattattctaaatttcccatctcaatgaaggatccatcacctaattagttatagaagccaaaaatctgagtgtcattctttttgcctcataacatcttacccatcccccatcagttatgattctactcaatttctcttcaaatagtttccttattcttcacacaatcacagtcggcccagtggtgtggtggagtaagagatgatagtgcacatctagttcctcctgactcagcattcagtgacagcacactgggagctggaacttggccatgctggaagtatcaccaaaccatacaaatcaggatttctgtgtatgtgtgtgagtcaactgttaaacattcaccagcacaccaatgcttccggctctcatgattttgcctctaaattactgcaaagcatcctaattgcctatttctaccacttttcttagaccactgtaatccattcttcttactggtaccagaaaaaaaaaatgtttctaaaatgcgaatctcatcacatcaccaccctccatattaaaataattcagcggttcttcatttcccttaggttaaaagcctaaattcttagcatggcatacatggcctatactagactagatactattagtgtcccatccttatcctcttagcactcatctttcttatacatgccaccagcttgttaccacaagcacatgtacgtctctgcctcagggctttttctagcctcaggggaatgcccccagtgtcagggagttactctcctgggagcaggcctcacccaaaaatagatgggagttgggtggatatagatcccagttcccatttgtcaagtgagataactcagagacacacagtctctccagaggtccccagtggatagatgcccagttgcccacagttgtaatctgctttcacttcccctcttctaacagtgcttcctgcaatcacctcccaaatgaaccactgaccttaaagtttttatctcagggcctgtttctggagaaacccaactgaagacatggcctttcaatgtctacctgttctccacttcagccttgtcatgcttcccttctccctttaagctctagctatacagaacgttacttatagttctccaaagggaaaatggggtctcaccctttgtttctttgcataagctgctcattttatctggaataatcaaccttaattccacctttcttcatccagggaactcaagcctgtctttccaaacacagctctgtatctatctttttcctgatcactaccatcccctcccccaagtatggggctcttacttgttcttatgtctcccggtgcttacaaggctgctccgcaatggattgtgggtacctctgggctcttctccagctatatacacaagccctcatcctactcccacacctggcatggccatgacaaatacgatcaagttaataaagctttgttaaaggaatatattttacatgacctattgtcccttatgttctcatccttggagaaaatattcaataaggagtttaccatctaggttgagagataaaaaaaaaaaaaaaaaaaaaacctgttttcttgtatttcccagtgattataataattacaagtattatcaaaaaacaagctatttgcataaatatagctaaacacctcttttggttcagcactgttaatatgtttcaccaagatccttagttttctagccctgatgttttcttattatctctgcatttcagtgttgccttccaggctctgcaattaagcaaattctttaaaattttaagtaaataagctttcaccattttaaagtggcaaaacatgcaggagcaccatttaatccgctgattcttcctttggaaggggtttctcagctgtggctgacagttttgtgactgcaaatcatccttgtccagaagggttgggctttctgttactcgtaccacagtactctgcgtcctctgcagaatatacttatttgcagcgtttcagcagggagaccctgggaggatgagtcatcgtccttatccagagagttgcccttgaggccacactgagaaactgttctctctcttaactgtatagaacaggctcagatcagaaagaaagtgttctgtttacagaaaggtttcccacctaggcaggaaatgatacttcagaaatgctgaacaataaatgcaaacgggatataatgtcatttcttggacccaaatgcatttcaaggcaatgaatcccatccaaacacaccgagcactcactgcatctaaaactctgtagtaaattccagggaagacagagactacaagacaaggtccctgaacccagcccctaaattatttgtttaacattttgaatatatttaagtatctgtgggagataatttatatcaaataactagttataaaggcatagcactatcatgtttgtatataagtgaacaaatgtgtgaatgcttgaatttatctctggattctatattcataactgattggtatgctagtcaaaaccttttggaagcacgttttcaggaacccccattctcatatctccttcctgttatcattatcggcactaatgacattgagataaccagtgaattacacaggggaaacagaaatcaggcacagaaggccaagatgaggctaagagataagctgatgaggaattagatgcaagaggtgggcatatgacaggcatgaggcttgactttggattccaagacgctggggcagcagagcagaccagggtggtaggcaggcatcaaggatatgaggttcagaaagtccaagcaggtgtggtaatctaagcaagtcataaagcttagagcagccaaatgcaccacaatccagtaagcataagaagcctaagaggaagggatacagtaaaggagcttgtggaaagcttacagcagtatggatgggactctgggagtgaaccaaaactctggagccagacctcctaggttcaaacccttattctaccaactaccaggtctaatattctaccaactaatatgtctctatctcaggtttctcatctgtaaatgaggacaaaacagtgttattgcctcaattccacccgccaacactatatgtgcctcaaagaaaggaaaaaaacccattaacaaccaaaagtgtaaaatgctattgatcgatccctttgagatgtaaaaattagataaaaagaagtgtttaagaatggatgtaacaagggagtataggagctttttatcacatagggctgctaggaaaatcacataagttaatgtatgaaaagcacttaaaatagcacctggtagcaggtgaagttccttgcagccccatggatgtggggtggtgggaaatgttttaattgtaacattttggtgtctgaacttagaggcttcccctattttacttcctgtttttgttttctgtccccatccacaaatatgacaccttaaaaactcaaaaccagtgtgccagaatgagccgatcctctcattgcaaaggtggtttctgatctccagttagactcagagctgaggagacatatggatatgtcaattcgtgtgcttgtggtgattatttcacattgtacatgtatatcaaatcatcaaattgtgcaccttaaatgtatacagtgtaaattgtaaaatataggtcaattttaaaaataaaattaaaaattggcttcactattttacctacatctctgtgttcccatcttcactaaatgtatgcatgacaatttcttactatttgtcacatctttggtacttttaagaatttttttcataaactctgatggcattttttaatttatttaaagagagtccagtccaatttcactggtgaactctttaaaatacttttttaaaacagataatccccaagatctataaactgtttcaaatgacagaaaaaaataggtaactacctagttcatattgggaagctaaataactgtcatacctgacaaaggtggcacaaaaaggaaatgtagaacccaatcctatttatgaaaattagaacaaaaattccacatcaagtactagcaaaaaatttcattaactatttcaaccttccacaacatgacgagtagagttttcattagaatgtgcatatgacttaagacaaatattaaatatatatcatatcaaaaatcaaagaagcataaactatctgtgtcaaagatgcatttaataaaattcagtagcaatttctaagatattttttgtcaagtataaatgagaagactgtgacttcactttggttgaaatgaaaaatgtcaattatcaataaacatacacaaaaacattaattcctaagtagaacaaaaatgcctcttttaactatattcttactttttcagtgatctggaactgttgggcgaggcaataaaacaagaaacaatattaatatcatttagaaaagaggacacaaaaattttctttttttttttttttttgagacggagtctcactctgtcgcccaggctggagtacagtggcatgatcttggctcactgcaacctctgcctcccaagttcaaacgattctcctgcctcagcctcctgagtagctgggatattacaggcacatgccaccacgcccggctaattttagtatttttttagtagagacggggtttcaccatgttggtcaggctggtcttgaactcctgacctcgtgatccacccgcctcagcctcccaaagtgctgggattacaggcgtgagccaccatgcccggccaaaaattttcttataaaactcaagataatccactgaaaaattcttaaaatcaatcaagatttagtaaactcacaaaataaaaaaaaatagaaagtataaagtgttctatttatcaaaaaaaaagctatatgataatgaataacaacaaaatatgtacaaatacctcagataataatcttgagtatatgtactctagagagccaggaaaaaatacttgcataaatggagatacatactacgatccacctgtaaagagtgaatcattaaaataagtcaatcacttcaagttaatttatgagcttaagtaatacacaaaacagattctattattaatagaacaaatctcaaatggaagaatattcttttaactttttttgtaaaaggataatagttttcggccgggagcggtggctcatgcctgtaatcccagcactttgggaggccgaggcgggtggatcatgaggtcaggagatcgagaccatcctggctaacacggtgaaaccccgtctctactaaaaatacaaaaaattagccgggcatggtggcgggcgcctgtagtcccagctactccggaggctgaggaaagagaatggcgtgaacccaggaggcggagcttgcagtgagcccagatcgggccactgctctccagcctgggcgacagagtgagactctgtttcaaaaaaaaaagaagaagaatggttttcaaagactgagaacttgctctctgttaaacatgagaaataaaaataaaattctaagctcctcaactgactgaacagacaccctattggccaaggagatcccagagaaacctttaaaactgagttcttggccatgatggcatgggaggtcgggcatgcctcattatacctcattactccttaactgccattaggctttcttccctaagtgctaaatagaaactagccctttcaaaagacttgctccaccaccgttttcaaccatctcactgactgctgtccctctctttttgcagttttgacagagcaactgaccagcattccttcctggtaagagaccactgtccatggggtggttctagccaatccatagaggctgcacacagagggactttgtgtccactgcttcacctgttgaggtacagggtctaattgtaatacatttaaatgttaagtctctaccccaaagtgaacatcagaactcatgttgcatacatgttggcctactatgcatgcctgtgcctccccttcgtgaatattcatagctcctcctataacctgttgaatgtgtatacttagctaacctactcagcataaatttctgttcccttttcccccctctcttgaactgcctgtttctggcttcccagcctgtcaaaatggccaccctgtaggctacaactctttataagaaataaagctctcctttccaaatttatgaacctcctaatccttcaactgactaacatattataaaactgcaacaatttaaatggcatgtccagctcataataggcattatgtagacatttgtttaacaaatacagcatgaaacaatatatagatcaaggcagggcacagtggctcatgcctgtaatcccagagttttgagaggtcaaggcaggtggactgaggtcaggagttcaagagcagccaggtcaacatggtgaaatcccatctatcctaaaaatacaaaaattagctgggagtggtagcacacacctgtcgtcccagctacttgggaggctgaggcaggagaatcacttgaacccgggaggcagaggttgcagtgagctgagatgggaccaatgtaccccagcctgggcaacagagtgagactctgtctcaaaatatagatagatagatagatagatagatagatagatagatagatagatatgactaagtagtcttgaaatgtaacctagaatgtatgagaatgtagtttctttttttttaaaaaaaaggaaattttaacaagcagtgaaaaagggatatatgctcaaaagtgagtggaaagttttcatatttttaaaatttcaaataagaactttatcttataccatccatcaaaagaaattatacataaagtgttaaatataaaaagaaagcaaaaacgatcaacaaaaaagttaaaaaatacatatttattttaaaatctagacggctcgcaagccccaaacgatcacagtactcacaaatgcagactgacttggaggagatacaactgaagtagatagcacggtgggtaaggacatgggttccagatcagacctcccatatcccagctcggccacatgctagatgtgtggccttaagtaaattaattctctatgcctaaatttccttctcgttgggatttaatgagtttccattttatagatttgtcgtgaagattgagttaatattttaaagtgtttagaaaaatgcttagcacagaagaagtactgtagacattattctaaatatatatgaaaataataaacatctatatctaacaaagaccatggatgaaatgaaaaatcagcctgagaaatatttgaaatatttgtcagaaatggattttcttaatttataaagagtttttgcaagttattaagaaaactcttaatcagaatcaagaagtagccaaagtctcacaaataataaaaagatagaagccctgagttgctttgggggcttttcagcgtcaggaatgcaggctgcttctatttttctgctccactattgacctttcccaaggtcacaccatggtgcacaacagttagagctgcagccattatgctttcattttagccagtaagaatgaggaatgggcaaaagatctcatttccctccttgaaaggggaatattctcctttctccctataattctccccattctcgctagaatttgcaaatgtcatattttccggcatcatatgaccacactcaactgcacgggaatatgagaaatgctgtgtttgttccctgcgcctacatccttagctaaaaactggagattttattactaagtaaggatgaagaacagccattagccaagaaatggtagtccctagtacaaactcagtgttatctggcatgaatcaggtaacggccagtagtaaaagatacatggcagtaaaactgccggtctcacagactgcttttatgactattatatggtataagcttttttaaaggcaaattttaattttttttaagtttaaaaataggcttacattttaacccgggaattacgttttacaaaaatatactgtggaaataatgggagattcaatgagaaattaacatacatggatatacgagggtatttactacaaaactagagtagtgaaaggtgaaaaataatcctaactgttctacagtaaatgagagcatacccataaaagggaacattgtgatgccattgtagatcagggagagggaggggaaggggaagaactgaaatagggaaagggagggggaaaatagggaaggggaggaggagacaaaaaataccaaattagtgtgatgcctgttttataaatttaaatattaataacaaccaacctttatcgtgcacttacggtaagtaatttgcagtattatcacatttaatctttataataccctattggtacatactgttattatcctatttttacaggtaagaaaactgtgacatggagatattaagtaattgcccaaagtcacacagttatccaataacaaaaagaggatataataccagtagttttttgtttgtttgtttgtttgttttgagacagatcctcgctctgttgcccaggctggagtgcagtggtgcaatcttggctcactgcaacctccacctcctgggttcaagtgattctcctgcctcggcctcctaagtagctgggattacaggtgcacaccacaatgctcagctaatgtttgtgttttttgtttttagttttttggttttttttttttttttgtagagacagggtttcaccatgttggccaggctggtcttgaacttcggacctcgggtgatccacccacctcagcctcccaaagtgctgggattacaggcatgagccaccatgaataccagtaggtttaactcgaagtttgtagttttctcatgtcctgactgaagagacagatgataaagtgagggaagatgcaacaaaatgtcaactctggtaaccttggtgataatttcactaggtatttattttcttccttattcttctgtaaatgtctaaaaattttatatgatgactagttattttaataatgagtacaataaaagaaaactcaagtgttaccagcttgtactatatcaacccatgttgcaggctgagatttgacttgtttataaatttgaacttatgcataatttattagacattatctaaagaaatgttagctgttctcttgtttgcccatgggaacagggaaaaaatatctcccacttcattgttaagttatgctcctgattttctcatcaaaatgcctgacagataataactgtggctattcatagacacatgaatttactatactaatatccagtgtcctgaatgtaggacagttgcagtataagatgaatgacacattaatgagtttttcttccaagtagctggcatcaggtcctgtaaataatatcttttttcgcacaaaggagaacacatagtaggcatatgatacatatatgcagagtagaataaataaagcccgctcaatttcaacataggatttgtgccatgctgcataatttaacatggcagtagtatttcattccacaaatattttggagcatagactctgcgtgaggtgtgataccagggttggagctccagcaatgaaacaaagcagacaaggtctctgacttcatagggcttgtcagcaattaataccctagagaagggataagtaagctatggcatgcaggcacattttagcacaacgtctgtttttgtacctctcatgaactaagaatggattttacattgttaaatggctggggaaaaatcaagagaagagtaataattcataaaacatgaaaaatatatgaagttcaaatccagtatccgcaaataaagctttatctcctcaagtatttgcagaaaacaattgatgaaccctacccatagaggtatctattttaattgaagacctatgaggactgagactttggaattttcactaaacggcatgttaaccccgcttctcagattttgctagtaattaaaatagatactgctaggggaggggtcatcaaacattttctataaagagccagatagtaaatatttgaggctttgcaggccacgtattctctgctgcaactactaaactttgtctcggacaatatgtaaacaaatggatgtggctgtgttccaataaaactttatttgttaaagttcatttctcaattgtctatggttgtgtagctaaattatggttaatggaatgtcactgtgctttcctagcggagctcaggtaaaccattttgccagagtgaaaagggactgcagctgtttatttgctactattagctatttgtcaagtgaatgttagagaaaaactaatatttgtgtctgagttctgttcagagaaaaggaaaaaagacaaactaatataaacactattgtcttctgaaataacatctttgcattcttaataagaatggaatattgctaagcatctggttttatatcttctgattaaacattactgatacaaagatgattaaaggctctctgaacatactgcccaaaattttgaatcttggttatgtcttgtaaatactgtggttaaaaggcaaaaactacataaatatatctacataccaaatgttgacaagggcatgaataactagaaccctcatgcactgctggtaagagtgtaagtcggtaaaaccactttgaaaaacagctggtcaacatctatcaaagcttaatatatgtattccctatgatttaataattctgctttatgtcctcaacagaaatgtatgcatattacatatcgaaagacttctataggcatttttattgcagcaatattcttaaaaactcaaaactagaacaaacctcaatattcatcaacagtagaatgaaaaataaattgtggtatatttattacaatgaaatatacacagcaatgagaattttaagaaaaacaacaacaacattgcactcaacaatatgtttgaatctcataagtataatattaaggaaaacaagccaaacacaaagagagcaaactctacaaagttttaaaaagataaaagttatccaggctgcttaaaggggttagttacctggatgaggggaacagtggctgcaagggggcacaatgggggcttctgggtgctgataatgctccctgtttactgacctaggtgctggttacatggtatgttcaatttgtgaaaattcatctgtatacctatggtttgtgcactttggacttatctgagaaggctcttgctactttagaaaaaatgcaatcaatccaatcaattttaaaatcccaaaatatacagagttagtagatatgctacttttgatgtgatagaaatggatatgcctgaaatagcaagacattccatttacgatgatatatctacacgaacatagagcccacgagtagatccctctgacacaatgataggaaggacccatgtaaggactccctccctgccccgaacctatatgctaccttatgaactgaggaagccttgagtcaaagggtcctttcttttaggctagcaataatcctgcaaggaggtactctattcccatcacagttttaagatttgtttagagaagaaatcagttattcctttatactgagattttttctgcctagttgtcatcagaaagttcatgtggcctgtctttgggttattccagtttacacaggagtttaagaaggacaggccaggacaaaactgagaacatctctaatgtaactctctgtaccgctaatgtttatacaaaacacacacacacacacacacacacacacacacacacacaccgcttacctcaagcctgaggccattctcaatgagacattactgggaacaaactctaattccaataatgttcatgagattgtgctctaaagtcttaattgtcaagaaagctggaattcgtcctgtcctacttatatctgtaacttcagtatctagcaaagtgccagacgcataacaagaagtggctaagtgaaatattttatcattttaaaaattatgctttggaaaactaataattaaggaaaatattcacaacataaaactaactaaaacaaaccagggtaaaaaactgtaactatatacacatacacacacatagacacacaccacagctttaaaaccaacaaaaagcatatgcaagtatcaaagggaggaagtagtaaaaatgattaatttaaaaagtatagaaattattggtgacttattcacttgttcttgcttcttcatagtttccaaatttgtaataattaatatgtattacttttaaaactagtgaaacaatttagaaagcacaaaaattcgaaggactcatagaaacaccaacaaaaggctgggcgcggtggctcacgcctgtaatcccagcactttgggaggccaaggtgggtggatcacgaggtcaggagatcaagaccatcctggctaacacggtgaaaccccgtctctactaaaaatacaaaaaaaaaaaaaaaaaaaattagccgggcatagtggcgggtgcctgcagtcccagctactcgggaggctgaggcaggagaatggcatgaaccagggaggcagagcttgcagtgagccgagatcgagccactgcactccagcctgggcgacagagcaacatcttgtgcctcctctctgctaatattgacacgtgctctctcttttctcccctctgtagggcctgaggccagtctccatctgcacatccctttccctttcattctaaagagcaagcaagtcaccgctggcattttcctcctcccacgttggaagcaatggtttagcactctggtagaaacccagggcactgttacctgcactcctataaaactgcagatacatttcctttatttcttcacttcagatatcttttttttagatttcaacttttaagtatggaggtacatgtgcagatttgttacatgggaatatcgcatgatgcggagatttggaatacggatcgggtattacgctaactgcctgggtgatgggaacactttagatttctgaggctcagcttactacgtggggaggagtggtcaggctttataacacccctagtttgctgcctttcctgaattcacatagtctgtctacttcttatctcctagaccaaataggcttctgctcaaattttctctgcctcgagttttcttttcttctggaggcaacttctgagcaccagctctcctcgggccctatgtcacccccagttcttagccaactcagccagtctctacaaaatgactcacacatgatctaaagaagccacttattccataatattttaaataaataccccccataccacagattaaaggatgattaagagatgcttcatgtcctcagaatgcatgtttattaggaaaaacagcataacaggctttaaggcaggctttggggaagcagaaagatgtggaaaaaaaaaaaaaaaaaaaaagagatgagaggccaccaaagagaacatgttcatttttacagtctgagaggccctacagccagagcagttcaagattgctagaccttagaagaagcctcagagatcactgacggcctcctgtttcactcaaaaggatacagaggaccagagagtttaatggatttcctcccaaatatgtagacagcactgttacctgctcacctacaaaattgcaggtgcatttcctttatttcttcacttcagatatcttttttaaaatttcagcttttaaatatggaggtacatgtgcagatttattacatggaaatattgcatgatgctgagatttggaatacagatcgggatttctatgtcctgtataggaaaatgtgcaatgccgatatggtactatacattttctatgtccatatattttccatacccttgcatcttccatgacaactatgtgtttaggactttgggatttttacagacaggtacaattataaacacaaaaccgctgattgctgagtatacttgccaacctatcattttgctgagtaattttattttaaaaaaggcaaaaaaaagaaaattccatctaccgtgaacatcattttataagagacataaccagagaaaaggacgttcatttaaatggtagaaatgtgaaccagtgttggggaccccactgactctctctacactgccccagtttatcagccagctgctacacaaatgggttcacatgaatactaagacctaggtatactggttttacctacatgggctcatcttaatatccagtaggaaattacattgaccgtccatgtctgtttccaaccaacgtctttgtttgggttctcaaaagcagacacacagccaaagctttgaatactaatagtgtatttgggagacgagtggtggaataaggcagggaagggaaagaagcaactacagtgtgtactgtgagcaactggctcaacatggaactgctggggacctctaggcaatacctcagatatttaatgatcacctccacatccatcattggtgaagcactgctcccaggagcatctaactccctagcactattggcctgctcctgtaaccacagaaagtcttcaggcaaagagacacaactgtttgtgtgagtctcctgtcacagagagtgctggggggacatgatgtggcaccaacaacattaatattgagactatttcttttttaatgctactattgggtggataatttgtatgttttaacaaataagaccattttttttattccctgagttttcaaaaggcattctagacactttgtgatctcttttttagtaagaacttgacacatccaggagaaaataagagtgagaactaaggaggtctctagagcacagacggtgatgggactgacttatgttggcttttgcctacttaggcagttagataatagaaaaaaaaacacttaggacataagagatttagggactgtcagatgagtgtgtcaaaaaaagttgaatttatttccccttcctaataagctaaaattagtcactactgaataaatcaaaaaggctactggcaccttatttcagaaacttgccaaattctgatgcataagactttgttgtttgtgctttatgttaactctggattcctatctggttataacaaagctttagcatgatgtcttttcatatctataaccatacagagagccatattaagacataaggaaaaacagggttaagatttattggaccaggccctgtgagaagatttagatattcctttatttgctgaaaatctatcattcctggcactgtgtataggctcaagattcaaagatcaggaagatgttttcctgccctcaaggagctcacagtgtaatagacacaaaatctgaatacaaactgaatacaaagtggaaaattaggaattggagtacccactgttgccaaatcaagccaagggtttggaaactggaaatccagctgaggagtaggaaaagacaagtctcagtgtccaaaaacaaaaaacaaaaaacaaaaaaaaacaaacaaaaaaagagcttatgtatagttagaccacagcaaaatcaattgaagtataggaatgaccctaaaacttggacagaaattaagcccttgctttccccggtcatccttaatatttttctcttggaaaccactttccctaccaggtccaaatagacttcaactgtgacaaagacatcagtctcaacatttggacctgaagttagtcctgttgtagactccatagcaggcatgcatgaggtgagccctgggtaccccatatcttgccttcacacttgctgtttatattgtaggattgagtttttgccttagtatcatattggcattgcacatttccctaaatctcagcccacatgaccagcactttaactatttccagacatatgagtacatccttcttaccaaggcagatagatcctcttgccatgtgtctcaccgtctatctcccacaatctcttgcaagcttcctggatcctgttctgattaatcatcttgtcccatacttggatgactctgagtaccaaacattgtctgtgtccctgttcctgtgcccccatctaacagtcagggtccctcccacagggcccctgctttctgcttccttccagaagtctatgtactcctgaaatccccaaaaaaactcacagaagagctccactcatatatgatattgggcttagtttccagataatgtcttcccaactagattggaagtgctgtcaggaaattaaaatataagggcctactaatacatgagaaattaatgcatttaagtatagtaagggaaaagcacatagctgctgcagttgcatctcaataaagagctaaatctctagaagaagaaagtcgaaacatagtctcataaacttgactgcaggctgtcacccacatatttgaaataataaccagaggtgctgagttttcaattttctgataatataatattagtaattttaacccaacatccaatattgaccctggaaatgttttgaatttaagccacaacatatgtacaggcagcataactcattggcaagaacaagtgccaaggtcacaattcatgctggaatcatttctgccacttcctccccttcaaccaccttctagttgaagtgatggagatttggtagcatctaggaagttttggcagctgatgacaagttattactttgacaataacaccatgttattattttgaaattttagctactgagccacaacactatacacccaagacagtcctctatggaccagctgggtgcatggctttgaggcctgatggtaaggccttggcaggatttgctgttcttggaattacccactgctatacaacctcctccatctcagttgacccatcttagtttcccatctctatatttcactaacaaatcagatttagcaccattgttcattaaaaagaatgatgtataaatggaaactccatctaacagttgagtgaagagcttgtgtacttcccaggacagtgaacaaaatcatcagacaagaattaatttgaggcttctcttccactgatatttgcaatattcttaaattggaaccattatttctactggaaaaaaaaacaggtagtatatgtttactaaaatcttattattggtacttaaagctctaaatacaactgattcttgaaaagataatttatataattactactgattattcattccggggtgatgatatcctagtatatgcaacaactctgtatgatcatattctgctaatacttccatgttccacatgtcttctagtcctcggtaggcgtatctaagaaaatgaaagtaactcatcctttccaggacactaggggaaaacagcaacacacaaagtaagccatcattagatttggggcctgagaaagcatttgagcatgagagaaagatgacttcgctttttggtagatacataccaccccttgctacatacatatgcacgcacatccactcacatcccccatcacacacacacacacacacacacacacacacatgctctacgaacagctgtctgagcagattttagggcataatcctaccttcccacagaagtgtagtgtgttagtctgttctcacgctgctaataaagacatacacaaaactgggtaatttataaaggaaagaggtttaatggactcacagttccacatggctggggaggcctcaccatcacggcagaaggcaaatgaggagcaaaggcttgtcttacatggcagcaggcaagaaacggtgtgcaggggaacttccatttataaaaaccatcatatctcatgagacttattcactaccatgagagcaggatggaaaagacccacccccatgattcagttacctcccaccaggtccctcccatgacacgtgggaattatgggagctacaattcaagatgagatttgggtggggacagagccaaaccatatcgggcagcaagaacaaagctattttttctccttacctagctgcactgacaacactcagtgagattattgggtagagcctcaacctcattcttacagatgcttcaatttataatttagtaatacaaacaagatatcttgctattgtacttcccttttcactactaattgcccttaacaccaagcacgttacagtcattaaatgcagtgctaacatcacccttccactcttgaaattgttaacagcaacagtgaacacaatatataacattttaattttttaaattatttttaaaaatatacttccacatctttttcccctcactgcattattgacacatgatacatgtaaacacacacatagatattcacccattcccacccccttgaaaacacacacaaacagcacatacacacacaagctcacctacattcctacctaccttcctctccttcccccccaccacacacacagacttagaggcaggggcaagaattgttagaaaagccacaatttatctgacagaatctgacctttctaagatttggattcccaggagcaacagaaacaaaatgtaatgtaatagttagtaaaacagtgtttaggtttgaggaaatgttactgtgccaatgagaaagatatgtgcatatatcttagtttggggtcccctagaggcagaacctgagacaaggaattgccagctgagcgggtagtttatttgggaaggaaatgcaaatgacaggggaagggaagacaggcaataaagagtacacgagtgatgagcaggtttacctggtaagaaattggagcttgagccctctgagaaaatctgagcacatctcaaaattatcacttctaacccaaaggcgaaggaggtcgggatttgtacccccaactctctttagtaattggttgagggatggggtgggaaatgggtaattccgtggcactgtttatgacttgctgcaggtaggcaaataagaccctggaggccagagagaagcctcagaacaatacatttaggtacaggcaagttggatgaaaatggtgaaggacacaagcgacgtgctacagcatacatttgcttccgtgtatgttttagtatgtactagcacgtatgttttcatatagctatgtgagcaaaattgcttctataaatgtggcacaagacactgtgccacacttatagacacatagacaaaacattaggccacagacaaaaaggtaggccaacagcgaaatgaaaaagatcctccaaacggcaagggaaaaacctactgaaaagaaaaacagaacgactcaactgtagatcatggacatcagatggtggcttagaaatgccacaatgataaaatgcttctgcagtagacagaaataacattagctcctcccaaccatgaaaattatgaagaaagccacatgccagaatcaccacaaaatgacagttatctggattttaaatagcttacattcttccaaattaatctacaaaaaaaggcaagataaaacaatatcagaacaactggggattcccagcaatttcatgaaaagacatgaacttgcaaagactagaatagaaagtttgcaccagataatgttcagataaacaagatagttccctgactgctctaaaaataggcatgtagctcaacaagatagagaccagccaactagacaaagaacaaagagcttgtggtaaactgcaaaaatagccacgaatcttcctttccccatcaccaaaccctcatgatcaatgtgcctttgtaactccacccatcagtgagtgggccccacccagtttccaccactagaatctgggttggttctcctgacttggctaaaggaatagaagtttacttaacacaagcagaatcctgcaggctgatgaacaatgcagaacccaggttccttcctgatacggtttggctgtgtccccacccaaatctcatcttgaattcccacgtgttgtgggagggacctggtgggaggtaactgaatcatcggggcaggtctttcctgtgctgttctcgtgacagtgaataagtctcatgagatctgatggttttgaaaaatgggagtctccctgtacaagctctctctttgcctgctgccactcatgtaagacatgacttgctcctccttgccttccaccatgattgtgaggcttccccagccacatgaaactaataaaagtccaacctctttcttaagaaacttttaagaaacttaactttcttaagaaagttaaatgtctttcttttgtaaatcgcccagtcttgggtatgtctttatcagcagcatgaaaatggactaatatacttcccctttgtccccacctcaccaaactgctcgcaaactaccagacaaggaagacatatgcctaaggcccaagaaaggtgctgagtgagacccagaccagatgaatttcctggaagatggtggtagttttaggttactaatctttggagtaggtttgtcatgcagcaactgcttactttctcaagaccctgataggccttcaggctcaacatgcatttcatgctttacaaatatttattaattgcttactgtggcctgccactgttctaggttcagggtataaataaatgataaaaagagtcaaagtatctactctcatggagtttgcattcagatatgaagaaacatctaagcaaataataaaataaatatataatatgctagacggtgataagtcttgagaaagaaagaaaaatggggtaagggtgtcagcaagtgacagaggttgagggcactgtttcagacagcagttgggaaggcctctctgtggacctgacatttgcactggcttctagctacctgtcctctccatctcccacctctcttcctgtagttcacttcactccagtcacactggccttctcttctaaccagcaatgcatattgttgccttggagcatttatactccctgttggctccacttcattcatggaggtatctgcaagaagagcctctgagtggagggaacagtgagtgggggttgctcttacctgatatgggagaaactggaggaggagtgatgctcaaaatagtttccactgttctccagagtctaagctaaaattatctggcaagggtgtaggggttggggtgattccatggagagccttaactctaaaagaaaggtggagcagcatcttcctcgtcagacagggaatgaagatgccacaaaatgatcacctttcctaatctgaatatataggtgctttcagtatacccaaattcttacagtaaaagaatcttgagctagaactggatattcttgatcaaaggaatccaataagcaatatacactactgatttagttatttaaacacttgattgtcatggttttccctctgcaaagctcccaatgccattgtttattaccttcagctgttacagaatttgggaaaggggatgaggttctctacatgtctgatcccagagctagtgatattattccatttttccagatgagaaaaccctcagaaagtttacaaagtaaattccatacacgagatttcaagtcaagtttgtctcattccaattataccatgaacactaaattcccttctctgtatcccccaatcagtctttctttggctgaataattcaaaataagcccaactcaagtgtaaattagtacagccactatggagaacagtttggaggtttcttgaaaaactaaaaatagagctaccatacaacacaacaatcccactcctagatatataccccccaaaaaaggaaatcagtatatcaaagagatatctggattctcgtgtttattgcagcactactcacaatagctaagatctggaagcaatctaagtatccatcaacagatgaatggataaagaaaatgtggtatgtatacacaatggagtactattcaggcataaaaaagaatgagatcctgtcatttgtaaaaacatggatggaattggaggccattatattaagtgaaataagacaggcacagaaagacaaactttgcatgttctcatttatttgtgggagctaaaaattaaaacaattgaattcatggacatagagagtagaaagatggttaccagaggctgggaaggacagtgtggggctggggtggggtaatggttaatggatacaaaaaaaaaaatggttagaatgcatgaataagatctaatatttgctaacacaacagggggactatagtaaaaaataatttaattgtccattttaaagtaactaaaataatatatttggattatttgtaacacaaaggataaatgcttgaggtgatggataccccatttaccctgatatgattattaaacattacatgcctatatcaaaatatcttatgtgccacataaaaatatatgcctactacgtacccacaaaaataaaaaaaaaataaaaagacaaaaaaaatactcccacctccacttcttttacaattggagaacaactctgatgtctccattacattttcttttcttttatagcctgaatgtcaccagttcctgtaatgctttctcaacgatatgatgcccctatctttaaatctcactcaataatgtttttcttacagtgaagggactggtcttacacacatagcttgaatgataatgactgtaaaacttcccttgatctggacaactaggtttgttttcatttttggaatctgaaacagaaataatttcctctcccacatcacagtcattgactcattacatctacagtaaaataaaacctccaggtctttcatcctaaactatatttgccgttctccctctcagtctcatgcaatttgttttttatctaattgtgtcttggtttgggtttcctgagaagcagattatttgacaaagctgcaagtatgagtggttcctgtaggaggtgatccaaggaaacctctgtaatggaatgaggaattgaggcagtgaaggacaagcatacaataaagcattaccaaccaagtttccactgtgggcaaataaagtccaattcctttacagaattctaggagactgtgcagaacatacctcagagttatgccagctgagcagtgagaaactggatgatttgtccactaacaacccatcatgtaataaacatatccttatacttccacccttgcccctgaccaaaagggccaccaggacaagcaaacaatactgaattatctcatccagcccatgttggttgcctgtgtttaaatgttatgaagtaaatacaaggtagctattaattaagcaggcccccaaaccccttactatgtggagagttttagtaccccaaaatgacaaaactgttgttttttaaaatgccttttttttccaaaataatttatagcttagaattatgcaggctattactatgcttccttccaataaagtggaattagtactcatttgctataatttactatctaatcccattcaccaggaaaatgtcctcaagttcaggaaaacacttctcttggggcctgcttctttcttgcaggaaaatttcagcagaaaaatctgtactgtctcatttccagagcacttttggttttacagatacttaccagtgatactttaggatctgagttacttctcagtgaataaatgcagaggaacaataaggtttattgtgccaaattttgtttgcattagggtttttttaaaaagacttctaatgtcttcctatttcttatgctggatgattttctgacacacaacagacacactggaaaaggagacataaacagaatcgatgtctttcattcaacaagaaaagaacgctcccttcttaaggaaagacaaggctggatattggcctaattttcatcaggatatgtattccaattaatgaaactccaccaagagagatcattgctgagataagcctaggaggaaaaagctctgctctcccttttgttagatgctcttctcatttccattgacatatttcactgttatacagaccagaatattagaccgatctcatcatgtaatgttcttttagtttttcttttttcaatgaactgtgggtctcaatgaaaagctttgaaaatagtaaatgctcatgagagatttttgtggcttgacttttcactgtcacgtacaaacttattccaagagcaacacatttcctgattcctttcaaatattttggtcattaactttttattatctcctttgcaacaaggttacaattattgggctgttacagcactaaatagaatcgttcaatgaatagtaggtaaattttcatgttcaaaatattgatggttccttcatgcctcataatatccagagaacaacacagaagggtagttggaagaaggcttatcaagttaatctaatacaacccttcaacagctggacttttatcaaactattcagttagatacttttctttaggacagggatggcaaatgcacggtattagcatgctgcctcccctcaccagcatatgagagactgatcaatcagagtcctcataattaatctttttcaactcaaccctgaaggcagccaagactaattgatcaaagtaggcactgagatgatatcagcagatccctaaccaactttggcagtgtgatgcactatcttgataagctttccatcagcaaacttatacccaattctaagccacatgtgctcaattcataagtcaaagtaataggcacatatggccctcaactgttttatccagttgaaaacctgtgagccaagattcgcaaaagtcacgggcaatgtactcagcttcatggatggctcatcaaccacaaaatgtagaaagtagctacagtcccactttttctatggggaaggttactcttgaacaaagagcatgacttgcctctagcacaagcgtaagcacacagtcaacataaataatgatttttagtgaataagtcattgaaatgaacaattcaccttgaaattcatggggcaaagcacgctacccctccataaaacaaataaatgagatttaacctgtcctagagtatggctaaaaatgacaatatctctttgattttagctgtgtccctccataaagaaaggaaacctaatttggtcccctgttccttgaatgatacgcacttgtatttccaacatggattcacatcatctcataatccttagcagtcttgacctggagacttcaagcagcctgtcaggatgtttttaaaggaaatctctgctcgcttagcacgtttcagagatcctctctgccttaattctcaccgctacctatcagctaatattgttaagaggcaggcacatatgcaaagaaaattatattcttctggacaccttattccccttatttctatctaaaagattttctttgcaataccatgtcatcaaaccaaaagtgtttattgcctctaatctgtatatcattctgtactttccatttttctcccatgggcatgattttaaccagtaattcctaatcttttcaggcagtcctaacagcccagccaaccaattgatggtgtgtaaccttttgtttttcatttcaggagagacacttcccattgcaggccaaacttacaattattacactggcctgtatgttgctactttccttggaaattgcattttccatttctgacatcatttgttctcttaacaattccagtgagaatcttctcatgtggttctgaagaaatgggcccaagctttagcggaacacagcaacgcaatatgaatataaatttactaacatctaaggaatttgaggcttttgttcttcacccaactttgcctgcaaccacagacatcacgaggtagtgttatagtggaggatcaatattgaacacactctacataatttatatactgctttgtagggggcaactattacttgttttaatcattcaggacattagaatcttaactgcaattgccattggtgccagaacaaggcatggggctactcttccttgagcttacactgtaattacaaagggatgatttaagacacaaaaagcaattgcaacaaaaacaaaaattgacaagtgggacctaatttaactaaagagcttgtgcacagcaaaagtaactaccaacagagtaaacagagaacctacagaatgggagaaaatatttgcaaactatgcacccaacaaaggtctaatatccagaatgtttaaagcacacaaatgaattaacaagcaaaaaacaaacaatcccattaaaaatggggaaaggacaggaacagacacttcccaaaagaatacatgcatgtggccaacaagcatatgaaaaaatgctcaacatcattaatcattagagaaatgcaaatcaaaaccacaatgagtgagataccatctcacaccagtcagaatggctattattaaaaagtcaaaaaataacagatgctggcgaggttgtggagaagagagaacacttatatactgctgtcaggaatgtaaattagttcagtcactgtggaaagcagtttggagatttctcaaagaacttagaactaccactggacccagcaatcccattactgggtatatacccgaaggaatataaatcatgatgccataaagacacacacacacacacacacacacacacacacacacacacacacacacacacacgtgttcatcacaggcactattcacaatagcaaagacatggaatcctactagatacccatcaacagtagactggataaaaacaatgtggcacatataccccgtggaatactacccagctataaaaaagaacaaaatcatgtcctttacagcaacatggatgcagctggaggctgctatcctaagctaattaacacaagaacagaaaaccaaataccacacattcttatttataagtaggagctgaaacactgaatacacatgaacacaaagaatggaacaatagacacaggaacctacttgagggaggagggtgggaggagggtgaggatcaaaaaactacctattgggtaccatgttcgttacctgggtgacaaaataatctgtacaccaaacccccaggacatgcaatttacccatgtaataaacctagacatgtacctcctgaacctaaaacaaagttggaagggggaaaaaaaaaaagagtaggtttgctttaaaaaaaagaaaaaaaaaaaaaaaaaaaaaagaaatgcctgatgccacacctctgacttctgttggggcagggatcccctgggatgggtgtataagccttccctcttgtcacaggtcaaaggatacgatcagaaagggctactttctgaaaatcatcagttagataatagagccagaagtggtcattaataatggtggtcagaaaaatcatgatgtgaagccaactagaatggaagaagtcagtgcatatcaagaagaaccatgggccaggcacagcagctcacgcctataatcccagcactttgtgaggccaaggtggaggatcactcgagctcaggagttcaagaccagcctggtcaacatggtgaaaccccatctctactgaaaatacaaagattagtggggtgtgggggcatgaacctgtaatcccagctgctcgggaggctgaggcaggagaatctttgaacccaggaagcagagactgcagtgggctgagatcgcaccactgcactccagcctgggtgacagagcgagaccctgtctcacaaaaaggaaagaaagaaaagaaaggcagaaagaaaggcaggcaggcaggaaggaagggaaggaaaaagaaaagaaaagaggagtggagaggagaggaaaaagaaaagaaaagaaaagagcgagccatgattacaaggtagcaagataaaaaagtaaatctggattcataacctacagttgatacttgaaagtactttttatgaacttgtaggcccactttttggtggataaactagatgtattgactggtaaagaaattagggtataaatacacatggtaagcctggcatcaactctaattgttccttaaaaagaaaaggtgaaaaccttagccaggttttcctctcgtagtacctgagtctacaattcactacttctcctcttgtcctttgttctttacatgccaatttggagtggtgtcatctttgtaacaggggtaattaaccaactctacaaaagtgtcagactgtcaccaattgtctaacatcttctagctcttgccattaccaattagctccaattctgttctgtgctgtgttgaatatagtaggatttctgtcttccaatgtattccttgcaaatatgggctgcaaataacttcacagttatcttagaatggttcccctctctgagcagcagtgtaggagatggagttgtcactccgacttcccttaattctcaaagaggtagaacacattctagaatgggtgttattcaaaagaactgcctaccagaagacattgcctctgattttcttgtcacagaaacattttctctggctacgccgttgccatgtagtcattttatactggatcatgtgtgggctagagtagccagaattctatttttctggaagataaaggcagaaaattctgtcactgcattcattccaatctccaggatcagagagtacgagagttcttcattcatcttgttagtcactcaacccacagtactaactgagcacccactatggattctttatggattgctgaagtaggtgttgggagacggtgatgatgatggagaaatcaggaatgttttcctgagtaaattctcatctcaatggacagacaggcccaacaaacccccaaagcttgtcccagaaaaatacacaagtactgtgagcgatttattaattcattctcattcagctcctaactcactcttccatgcgctggttcgtgatgtggaggcagggcttcttcaatccacatttctgcttttctagttggagccctattaggctctaagggggctgcagagctggaggaagcaagagcgagttgcttctttctgtctgctccctctgaggatttctccaccaacacttcacttctgcagtggcagtgtctcccgtgacagcagctgaatgcagtttacagtttttccaagccgtgtgggatcagctttattcataaactccagaaccaaccatcctcagaggtctgggcttcaactccatggagactcctctgaccatctaagtttcaagagtattaagaattccaacctcttctttttgttttcctaggcctcaggggtgaagttgctttctgtagtttttccctccctgattccttagtgtgttctttcagtctttttagtttcttagttaacagtgctataccttgttaacaattctttttaccgaggtacatatttttcctgttaaaataactgaagagatttctgcctcctcactggaaattgagtgatacaaaatcccaagttactcagcctttccaatgcaacaggtttttggaaaccctctgaacagtcagattgctataaaagcccactgagtactcacacaggtgaattttccccttccctgtccaaatgcaacatcctcagcaatctttgaataagtacacaaagtcatgatatttaaaatatgtacagtaacatatagcatccagtgatgtacaaaaactcaaaactatgtatacaaatctgggacttcatgacagtgagtccctacttgacgcttctgtggctcacagtggacaaagaagccttacaacctgtctttaataagaatctgcttggccaggcgcagtggctcacgacggtaatcccagcactttgggaggctgaggtgggtggatcacctgaactcgggagttggagaccagcctgaccaagatggagaaaccccacctctactaaaaatacaaaattagctgggtgtggtggtgcaagcctgtaatcccagctacttgggaggctgaggcacaagaatctcttgaacccaggaggcggaggttgcggtgagccaagatcgcgccattgcactccagcctgggcaaaaagagtgaaaccccatctcaataaaaaagaatatgcttgatggttgtactaggagcctcctggaaatgcggctataccctggctcgtactggcaggcccgttctctattcctgtgtttaggcttcactactgggtttactccatctgatttttgggtttggtgtacaaaaagcccctgccagcttcctttcctgaaaagctagagcctggtgtttctacctggtcaggctctgcctccaccggatcaacttccccggaaaaacttgcaacccagaaattcctgctgccaagatctcagccactgcttaaatcatctggatgacaatgacacacccaactcttaagataaatttactacaacctaaaacactgactatatagctcagtcaatgcttctagagtctccaggtttcagcttaagcctctgttcttccctgctcaaagacagagttggtcaagtgagtctaccaactaagaccacacagtttacagcaatacagtccttcactcaattccctttgaacacaggctcatatttggaaccactgggatctgcaatgtgtggccatgcaaaaatcttccatgtataatccacgttatgtaaagattgttttcctgggaatatgatgtgactctagcaagtttttaacagagtacacttgggccaggaaggttctaggcataagcgagcattgaatgaggagagattacaccaggagtagacccattctcaagtacaaacttgatggtaaacaagaagcaaaacccacctcaatcaaaagatgtgtccccatcccacacctcccagctccaagagagagttaatgatatgatcatctctgtttccctcccaggttcccaaagatctgaaggaaaaggaatgaattccaatatctgcctccaatttccccttcatttccttgcaatctgatgcatcatgacacttgttttgatttttatttttgaacacagccaggctcattcacttacatattgtctatggctacattcccattaaaagggcagagttgaatagtcgtgacagaggccgtatggcccacaaagccaaaaataatcactatcaggcccttcagagaaaaaaaaattgtgggctgggctgtgtgttttactcctgtaaaccctgtaatctcagtgctttcggagaccaagacaagaagatcacttgagccccagagttcaagaccagcctgggcaacatagtgagacctcatttctacaaaaaaaaaaaaaaaaacaattagctgagcgtggtggtgcacacttgtagtcctagatgcttgggaggctgaagcaggagggtcacttaagcccaggagtttgaggctgtagtgagctatggaggtactactgccctccagcctatgtaacagagtgagaccctgtctcaaagaaaaaacaagaagcagcagaaagaaaagaaaagaaaaagtttgtgaacccatatttattatcacttttggatatatatcctactattgctatctgttttaggatgatggtgagggacatacaaagcgagtggcttagcaatagctgaccacatctgaagctttgacaattatatcatgatcatttcctagcaggcagtttgtactacctgctcctgtggcaagcactttaataagtgttattatatatatttgtaataaccataacacatcttacttactcgatttttatagatgggaaaatatagtcagagaagtttagtaaatttcgcaaggtaatacaggcaacaactggtgaaagcaggatacatatcttaaggtaatccattatacagggcttctcaagccttaatgtgcatatgaattatctgtggaccttattaaaatgcagattctgattcagaacatctaggatggagcctaagattattcatttttaacaagttcccaggtgatgctgttggtttgcagactatactgagtaacaaggcatcatatctatactgtgccttgttgaactgatttaattggaaaaatgttccatctttctacctaaatcaaagcctgaatgacagaatcagggatcagagttggaaggactaatttaataatagcagcattaagaatagctaacattgacatgttattatgtgcgcttgatgtgaattgtctcatttttatactgacaaccaccctagagataaatatcattttaacatcattttacaaaagagaacagttagtcacagagcaggtaagcaacttacccaatgtcacaccaatggaggagatgaaaatctaacttcagtctatctcatatggccccctgctcataatcactacactctgctgcatcttattgcatgtgtctggttacataacaaagacaagtgttagcctcatctttaagtgaggtcagcctctgtctttccagccactcttatctggactcacaaaaaccagcctcctccatcaggcttgatgatggcatgaattttattagcaatcttggcccaccttccaatggagttagaatcagtcttgctctcacagacacagcaccaagtgtaccacatgggttctgtctcactcgcataagccctagcctgggttgaagcagtctataaaacaaccttctatcctgtttccttctaccaaatattccaatgttttattgacaacaaaatatcaacttgaaccatagcctgcttgagtgggaccctgacacctcaccaattacttgtttctgagagtttcataatcccagtggctctctgaatggcacgtcgcctgtgttccattggcctatatgcctacctttaagccaatactatattattatgattattgtagctttgtaatgtactttgaaatcaggaagcgtgatgttttcacctttattcttctttctcaagatcaatttggctattcatggtctattgcggttccatattaaaaactttagaattgtttttaatatttctgtaaaaaatgccactgggattttaataagaatttatttgaatctgtagatccttctgggaagtattgacatttgaataatattaagtcctccaatccatgaatacaggatgtccttccatttgtgtcttctttcatttatttcatcaatgttttctcattttcagtatacaagtcttcacctccttaatcaagtttattcctaggtattttattctttttggtgctatcataaatgagattgttttcctaatttccttttcagattgtttattgttagtacatagacatgcaactcatttttgtgtgttgattttgtatactgctaaataaatccatgcatatatggtcaactgatcttctacaagggtgccaagaacatacaatggaaaaaggatagtctcttcaacaaacagtgttgggaaaactggatatccacgtgtgaaataaggaaattggacccttatctaacaccatacacaaaaatcaactcaaaatggggcagacttaaacataatacctgaaactgtagggatactcatatatgtaatctatctatctatctatctatatctatctatctatctatctatctatctatctacctacctacctacctacctatctgggactacatcaaactaaagtgcttctgcatagcaaaggtaacaacagaatgaaaaggcaacctatggaaagggagaaaatatttgcaaaccataaaaccatatatctgataagcagtgaaacctcaagatacacaaataactcctacaactcaatatttttaagaaaaaaactactaacccaattaaaaaatgagctgaggacctaaacagacattttttcaaagaaggcatatcaacagccaacaggtatatgaaaaaaaaagctcaatgtcactaattatcagggaaatgcaaatcaaaaccataatgagacaatacctcacacctgtcattagtctactgtcaatagactaatagactgtcaatagtcattgactattgactattatcaaaaaaaacaaaagacaagtgttgaggaggatatagagaagttggaatccttacaccctgttgattggaatgcaaaataatgtagccattatggaatacagtatgggtttctcaaaaaattacaaatagaactaccatatgatccagcaatcccacttctatttacgaaaataactgaaatctgactctcaaggggatattagcattcctatgttcactgcagcactgtggaaacatccaaaatgtccactggtagatgaatggataaagaaaatgtggtatatacatatacagaatagaatacaatttagcttttcaaaagaagaaaattctgcaatatgctacatggataaaccttgaggacattatgctaagtgaaatcagccagtcacagtaagacaaatactgcatgattctactcatatgagatatctaaaaaagtcaaactcatagaatcaaagagtgaaatgaaggtttccaggggctgggagggatgagaatatgtaagagtaattaacaagcataaagtttcagtcaagcaagatgaataagcttcagagatctgttatatcacattgtacccacagtcaacatataatatgttgaaatgtattgtaaacgtaacaatttattgagagtagattgcatagtaagttttcttaccataatactaatactaataataaaaccatctatgttttaatcagtgtttgccagtcatgaaatctgtgtcactctatgaagagaatgttcagatcaaagtcagatagtctagaaaataccacttaatgttctcgctgaatgatctttaaatagccacacacattaattaattttctgccatacttcactggggttgcaatctttttcagcaaattgagacagagactccataatgagaacaaaactatatcaaacaccatttcagcaaaaattgaaaaatcaaaagtgataatatttctgaagtaatggctatgttgaaaagagtaaatgccatcaaatgcatctattttcctgtcaagtgctgtaatgagactagctgagaaacaagatgccaaattaatgccccttaaaggctgttgcattttcttccatcagttttcttctcctatcatttaggaatatcaataaactcccaaagagaagctttggcagttaccactgtcattttgtgtttctcttcccctcaaatgattcttactaaagacttcagtcacctgctatctccctctgtagtaatgtgcatcgaaaagaattgagcataagcctttgccccaaatcctcaatttgaatagtttcatcaactagaagcagttctgaagcccctgtggaaggcaaagtgcttggaaatctaagattcttacagttccatatattatttactttaacaatttattgagatacaattcaccttgcaagtcacccatttaagtgtactattcaatggtttttagtacattttcagagtattgcaaggatcaccacaatctaattttagaacatttaatcacccaaaaagaagtcactacccattattcctcccacctcacttccaagctcacctcacctcctgtcccgatcccccagcactaggaaaccactaatctactttctatatatagttgacctttattaaaatttcatataaatggaataataaaatatgtggtcttttgttactggcttctttcacataatataatgtttgcaagggtcatctatgctaaagcatttatcaatacctcattctttttattgctgaatattattccattgtgtgaacacgccatattttcttttttttttttttaacctttaagttcaggggtacatgcgcaggtttgttgtacaggtaaatttgtgtcatgggattttttttgtatagattatttcatcacccaggtattaagcttagtacccattagttatttttcctgctcttctccctcctcgcaacctccaccctccaataggccccagggagtgctgttcccctctatatgtccatgtgttctcatcatttagctcccacttatgagtgagaacatgtggtatttggttttctgctcctgcattagtttgctaagaataagggcctccagctccatccatgccacattttctttatgcattcatcagttggcgaacatttggattctatttacttttcggctactatgaataatgatgctatttacatccatgcacaagttgttgcatgaatatgttttcatatcccttccacagatacccaagagtggcattgctggggcatatggtaactttatgttcaacattttgaaaaactgccaatatattttccaaagttaccacactattttacattcctaccagcaatgtatgaaggttcaaatttctccttcacatccctgcccaaaacttcttgttgtctttttgattatagccatcctagttggtgtaaagcagtatctcattgtgggtttgatttccattaccctaatgaccaatgattttgaacatcttttcatgtgttcttggccattggtacactttctttgaagaaatgtctagtcagatcttctgcccatttttaactgagttatttgtctttattattgagtggtaaaagttctttatacattctggatacaagtacctcatcagataaattatttgcaaatattttctctcattctgtgggttatcttttctgtttcctgagagcgtcctttcaagcatacacctcatcctgcttttgcaaagttcaggcagtctgaatctgccacaggtgtgttggtaaatactgattgactgccaaaattatattgattccttcttgcccttaggaaaatatctaaacacttcattatggcattcatcttttgtaatctggcccgacccttctctttaccattactccctgcctttccccctgcccgcctgcacccaatggaccttaagcccctccttcaagagtcttttcactctttccgctgtctagaatgatccctccctgcctgccttttctccaaccatagcccccatgcctctccctccatatatatacgtactcatagtatttctgttcactaggtaaacccaccatctctaatgttcatgcttggatatacctcaaggaatatacttgagatacacctttcttggcttcctcggcgaagttagatactctgttcttggtattcccacggcattcttttgttcatctctctcagaaagcacttcacatatcatagcataatatgtcattcccctacgtgggcattttcccacaagactggtacaattctcctaaactaggatgttgcgagatttacttctggcacatagtaggggcttgcagaaactatcaacgctctttaaaaatattccagtttccttttcctttcaggcagacagttagcttgcatttgcccagccctttaaagttagggatggctgtgtggccattttggctaatgaaatatgaacagaaatgacatatcattaaaatgaggaccctttaaaagccaatgtgctatttgccgagctgtgttttcttactatagtgatcatgaaagcataattaagatgaaactgagtcagtgaaggaccacaatcagcatagtaccatgccataccacagtagacatgtactatgagtaaaacaaaaaaaatgtgtgttaagccacttcagtttagagactctgttaccacatcataacctagcctctcctgactagtgctggactaaatacatgtctgttgaaagaatgcaatgaaaatgcagtgcaggtcactatctctttagtttgcctataatggagtaaatcactcttctcttgctttatctcagtatgtatactgttaaataaatagcaatgattgcttcctaaatgtattctacttcactctactagtagtctgctaaatttgaatgtaaagcagaactattttctccttgcattacaaatggaacatctgaaagtcttcacaatttccaattcttatttcttgaaagtagcacactggattactcttacaacaaattttttaaaaagcattcaaaaataccctgttaaaatgtaccttctgaggcagatactcctgacatacagctgcatttgacttcaaaatttatcatgggaataagcataaattgtttatacatggatcatagatatttatccctatgaaaacatttggctttggagaatagtctgagagaagctgtctgggggttgaggtgggaagtaatgtacatggggttatagagtagcctttttcttcagcgatgcttgcagagaattcttttttagagttgaggattctcaaaatgactatgtcatttaagcacacaaaattagtgacttttgaaaactatgatttaaattttctggtggcaagcatatctaagtggataaatttataaataatccagtttattcctgagtcactgttgacctgtatactcagagatgatacctttctgttttgttcagccacttacttttgtacatatctcaatgtttgcactttcggctgaattttaatcgtttgattatatgtctgtctttggtctgtgaaaaacacattttaattattcatacattcctcatagaaaaaatagacccattttttaattgattaaggggttgcatgcatgagtgatgagtgaatgctaagttagttgtgagactttgagcaaaccgcttttagtctctctagacctgagctatccaatacaatatcgactagctacatgtggccagtaagcacctgaaatgtggctacatgtgtaaaatacacatcagattttatgtctaaaatacacatcaaattttgaatacttaataccaaaaaaaacctcacaaataacagcgttcatattgattgtatactaaaataataatgttttgggtatattaggttaaataactatttaaattatcacacctgcatctttttacatttttttattttcaaataattatagagtcccaaaacaattcaaaaatattacagagaggttctgagtgcctttaaccagcttcccctctgataacatcttacataactacaatacaacatcaacattttaaaattgacatttatataatacacacgccttattcagacttcaccagtttgacatgcatacattttggtgtgtgtgtgtgtgtgtgtgtgtgtgtgtgtgtgtgtgtgtgcatgagttccatacaattttattccatgtgtagctgcataagatcaccactaaaatcgagatgcacaaccattccatcaccgcaaagatctcccttgtgctactcctccataaacccatccttaccctaacacctcgtcagcaaaccctagcgaatcacaaattctccacctctataatttcttcatttaaggaatgttatataaaagaatcatatcatgtatccttttgaaataggtttttttccactcatcataatgtccttgagattcatcctagttgttgcatgtatcaatagttgttctttttattgcttagtcatattcatgggatagattaccacagtttgtttaacaacccagtgctggcgatttgggctgtttccagtttgaggctattaaaaataatctgctatgaacattcatctataggatttgtgtgaatgtaagttttcatctttatgaaatgaatgccaattatgaaatgaatgccaatgagtgtgactgcttggtcatatgttaaatacatgcttagtatttttaggaaactagttgtttaagaacataggtgtatagtgatatatgattgtggttttcatttgtatctctctaatagctaataatattcaataccttttcacgtgcttattcgccatccatatatcctcttgtaaaatgttcatttctcttgctgattttctaattggattgtgttttttatctgtttcttctggtttttttactgttgggttttgaaatatttttgcatattttacatacaagtcctttgtcagataagagatttacagatattttctcccaggttgtaggttgtctttccatcttcatagcagagtcttttgcagagcaaatttttaatttcaatgaagtccaatgtatcaactgttttcttttgtgaattcctagatcccaagtatttttgtttcttctaaaagatttatagctttacattttgatccactgatccgttttgagttaaattttttaagttgagaggtttaggtcaagttcccgtgtttgtctatgggtgtccaattgctccagcaatgtttgttgaattgcttttgcatctttgtcaaagggacatggttgtttcggtctatttctaggttctacattctgttccattgatctataatattcatcccttcactaataccagtcttggttaataaagatttataataagtcttgaaatcaggtagactgttttctctttattcttccctttcgaatttgttttagctattgtagttcatttgccttttcatataaactttagaataagcttgcatatattcacaaataatgttgctgaaattttgacaggaactgcattaaattgggggagaaattatatttttactatattgagtcttccactccttgagtatggtatgtttttctctctttattcagatctcggacttctttcatcagcatttagcaattttcagtatacaagtcttgtcatgttttgttagatttatacttaagcatgtcattactgaggagttattgtaagtggtattgtgttggggttcttttgtttgtttatgtgtttttgagacagaatcttgctctgtcgccaggctggaatgcagtgacgcaatctcggctcactacaatctctctctcccgggttcaagcaattctcctgcctcagcctctggagttgctgggactacaggcacacagcaccacacccggctaatttttgtatttttagtagagagagagtttcaccatgttgggcaggatggtctcgatctcttgacctcacgatctgcccacctcggcctcccaaagtgctgggattacaggcgtgagccaccgcacccagctggtattgtgtttttaattatggctccaacatgttcatcgctagtctgaaaaatacaattgatttttgtatgttgattttgtctctgcaactttgctgaacctacctgttagttctaggaggtatttttgtagattcctggaaattttatatgtagattgtgtcatcggaaaataggaacaattttattgtttctttcctaatcaacatgcttttctttctttttcttgccttattactctagctgggattttcagtagtgtgttgaataaaagtggtgaaagtgcctgcacttgcattgtttacaaacttaagtgtaaagtattcagacttttactattaaccatgttactgttacaaagtacatgtacaaagtacaaaaagctgtggtctttttgtaaatgtcctttattatattgaggaagttatcctctattcctagtttggctagagtttttatcataaatgggtgttgaattatgtcacatgctttttctgcataaattgatgaaatcatgcaatttttctactttagcctgttaatgcagtgttttattaaagtgacaaatttttgaatattcaaacagccttgcatccctgaaataaactccagttggtgtatgtgtgtatatatgtgtgtatatacatatgtatggatgtacatttatatattgctagattccatttgctaactttttttgaggttttatttcatctgtgttcataagggatattggtctgtagttttctctttgtttgtactggatttgtctttttccagtctcagggtactattagcctaataaaataagttgggaagtgttccctcctccttttctatcttctgtaataaaaacattgtagaatatgtgttaattcctctttaaatgtttaaaagcacctaggagagaggatatattttgagagacttttaaaaatacaaattaaaaattatctattggacagagccatgtgtagatcttagcctttgcacttgcaaatcaaagctttacaagagatgctctccaaagtcaatcctttacacctctacaaccccatgattttaagaattgttgtttgacttctttatgcaatgcaaaatgatatagataatcttgtttatctttctacttacctacatcatagttatcagaaatgaaatagttctggaaagcccttcaaatgcctcaaaatagaggcaaggttattattatttttaaaatgaataccaatatgttaacatttctataggaagtagttggtaagcaaggatttctctgaaggagcttattgcaggtgctaatcagctcacactattttttactgtctgtgctgaaaaaagaattaattacttcagtaacctcacttcttcacatacctaaataatgcatacccctattctgtggagaataaactaaatttgatagagaaaagtttaatgcgtagctaaagatagcactgtaatctccttgaaagaactctcagcactctcctccctccttttaaacagactttccttttctgaaactgctaatgaatggttcttgtatccttgtgattccctctctcattgtatatcctcccacatatttccaaagactattaaagttcattttcttccaatattcataagtaattttcctgaagtccattggatccttaccagaacaattgcaataacctgtccccgaaagtcttgttttctagaagcattgtttaaaattaagacattgcctttgagcttcaggtacaagatacataaagttctcactccatcactacaaagttccccagtggtctagtcatctctcattgaaattgtttcccttaaaatacgtgtttctccatcattctacaaaaagggcatttttttttttttaagacggagtcattcactctgttgcccaggtgggagtgcagtggcacaatctcagctcactgcaacctccatctcccgggttgaagttattctcctgcttcagcctcccgagaagctgggatgacagatgtatgccaccatgcccgactaatttttgtatttttagtagagatggggttttgccatgttggccaggctggtctcgaactcctggccccaagcaatctgcttgccttggcctcccaaagtgctgggattataggcgtgagccaccgcgctgggccaaaaagggcattcttgaaggtcattgatgattttcatctccaaaactgagtagtctacctccctcctgtcattctgaagaattttatattgtttaccaaaactcctcgacaagttctcctgccttatttcctactatgtagactctctcttcacctaccttcctgtttttctcttctcattatctaatcatatgaattctatggttccttaaaatgttcttaaacctgtctttcactactgtctatttgttcaagtattcaattagagtttcaactataacttctatgctgactattctcaaatctctcttcgtcttctcatctgaactacagtcccaaatctccaggttcagttagcatttttacttgtatgccccccacaacaccacaaactggacatgactgaaaccaaactcctctgcttcccctccgcctttcctgtcgaatggcttcaagattctctgcttcaataagtctctaacctggaagactgagtcatctttaattaaagactctttttatctgagaaccaggcaccaaatcaagcacattttttccctagaaactaggattaggtggaagggaaaagaccttgaagctaaccatatccacgtttaaatttattcatgtttaaagttatttaccgtaactttgcatgaacttggatatattatctaacatctctgagcttcaatgttttcacatgaaaaagacggaaaatacataccatgaagttgctgtggtaatttaatgagataatacacttaaaatgtttggcatatagtagaactcaaaaatgttagttgcttctcagacgtgatttttctatctgttccattctccgagttcccactgctaaactaccacactctgttcaagtccctcagtcccatgtacttgagatatcaaaaacaaagcccccatttttcaaccccacttccctgcattctactttctccaaagggacccacttccttcattaatgtcatatgactccttcattctaagtttcccactgttttaccatattaacttgatagttcattgactgtccttaaggttcctaaaagttcccttttcctttcccctgacccaaaccatccttctccatttcccctttctccttaacctgaattttttgtcctagtcctccaggctgccctgatttcttcccaaaggccacacttgttttttttccctgaaactttaacatccttctatctctaatttcatacctcctatagtatcagatcaaacccactccccttataggtctttgcctcaactctccagcctctccaacctcccttcggcccttcttgcctgcaaccattattaacacctaatagcattctaatttgtgtttgttgggctaattgtcttagtctggccaggctgctataacaaaacaccataaactggatggcctataaacaacaggaatttatttctcacagctctggagtctgggaagtccaaaatcaagttaccagcagacttggtgtctggtaagggcccgcttcccggttgacagatggccacctttccattgtaacctcacatcacaaaaaaggcatggggtttctctcaggcctgttttacaagggcaagctaatcccattcatgagagctgtactctcatgaccgagtcacctcccaaaggccccatctcctaacaccatcacctttggggttaggatttcaacataggaacttcgggggaacaaaaacattcaaaccacattcgatgttccacatcagtgcttacaagcacttgggtttcatacaccaataacatttcaaagcctaattaggctactggccattagatttacattctttcttgccctaggagagacctttaaaaataatttgaaatccttatttcattttaaaagtatattttacaaaagatagtagggcataatgttagaataaaaaagtttacattgaataaatttagatttgggtaaaaaagttctattatccttgttttttttgtttgtttgtttcttttttttttttttttcattttgatatggaccagaggaagctatcaggaaaatccttggacagggaatctccatgattgtctctctatacctactgtttctgtaacagggataattgatacttggagagttcctactatgaaccaattagtaaaactttgtgtgtgcctgtgtgtgtgtatgagacaggtactagtatgccattctacagacagcaaaactaaaacaattttctcatgactcacagtgaataaatggtgaaagtgatatttggacccagttatttaaggtccagtgttcttgattgctaactacaccacactgctgctacttctttagactctgtggtatgagtatgattctatatacaaaataaacataccaatatgtacaatgataattgcaacatttgccataatatagcacacctattgaacagaataatggccagatatatatcatcccaaggaaactacttccataaagagtatttataaattgtaaagtgctgtacagatgcaaaaccaactgtaattattatcatcaacagtgctaactggaattccataagtcaagtttgccttagaccatcacagcagatttattaaataaaacactatcactatcatttctaagggagtcccatatatgagactattttaggccagcaacattaactcatctttaagagagttttgaagaaatcggagtgatggcaaattagcccaattcactgcctgcaatatttcactctcttactgttgcctctaagattatagggactgccctaagcaaaatggtagaaaccgtcttaaacatactcttgtctttccttacataaccctttttatcttaccttgggggaaactttacacattcttcccatctttcccactctctgccctaaaagaatcttttagccagctgttccactggaaagcatctaaccgacaaattcacatttttgtgttttgtttttccaggaccatgctaataacataccaagccataagccatagagatacatatttagtgagaatatttcagatacagtgaataaggccgttgtagagatatttagagcaaagaacatcacactggtggcccttaattgagctgacaaatattttttccaactgatacgggcaattgtaaatggtaatgaatcatcctgaaagcacaatccctctcagtatcttcaatacccacaagtcttctaccagttctgtgtcatcacagtaattcaccacaatgagttccaccttaaagtgcactgctctctacccagattttacaactacccctctcccaacaatatgacttttcttcacttcactttcatggcctcttctatttttctgtatcacccacaaaaaataagaatagaagcaagtcacttcgtagtaaaggagtaatgtcctgtactattttcccgactggccacaagtcaacaaatggttctaaatttttactctcaataatttgctgagtaccttcagtcaattccagaaagattttggaacctcaatttcactctctgtaataagggagaacaaaatgacctctgatgtacccaacacctgtagaattctacagttctgtaatattaactattattcaaagtaaagatgaaggcataaagacagagaaacataatacatccttcaagaggtaaaagccacgtgtaactaaacaaatttccttttaaaataatgaataaactagaagacattgagaatgccttaaaattcctaatacaattcatggagaagtatggaggagttgtaatgtgacttgatcagaatatatccggttcaacaaccagatgaaaaaaaaaaattggtcaggtaatttgtatttatccataccagtggtttccaaaatacattccaaagaacactactaattgtaaaaaataataataaagattgcatttaaatgcaaactgagcccttgagggttgtctggacttagtgactcattccacaaaatagagtatggaaagggagaaataataattttacagtgtagaaaacttgaataacacaaattatccaagggaccgaggttgaccttaccaatgatgggtcacgttgacatcaggtacctatctccccagtatgatgtgatgagataggctcttcatctctgtgatattttcttccaaaagcccataaccccagtctaatcatgagaagttacatcaagcatacctttttgaaggacattctacaaaattcctgatcattactcctcaaaactggaaagattatgaaaaataagaaaaaactgagaaactctcacaaactgtacataactaaatgcagtatggtgtcctggagtggaacttgaaaccgaaaaaatacattaatggaaaactggtagcataaagtttggaatttagctaatggtaacacaccaatagtgttttcctatatttgacaaatgtatcatgataatgagatatgataagattagaggaaactgaaactggctgaggctatacaggaacctctctgcactacctccgtaactgttctgtgaatctgaaattattccaaataaaaagcttatttaaataattgatgaagatatccattagcaaattcgtttggggaactttggattaaacaactgatttttctcaatgtctgtaaatatcatagctcctaaaatatccaataagcattgtgattttaacagagagaatatagggtgctgtgtttctcaaacatatttgaccagaaacctttttatttcttcaaatagcatcttttacaaaaagtactgacacagagaagttttctcccaaggtgtcagacttctgtcctatactagaccatgatgaaattttaatcagtgactgactaaagagacaaagatgctatgaacattaaattggcagaagacttgaaactagagactaatatgatggatgacagaataatcattaaaattatatttcataggttacatcaattgatcaaacttaataagatgactataaaaggatacatacatagtcttcatttaggtaagcaaattaaaaaaaaaatcagctgagtaagtaaaagaagcaagaacttaaatgcacgtcatgttactgtgagcagctttgtgtctcaggagttcttaggtcaaattagtagaattgtcatgctcagtaaagatgccctaatagtaggagtaatgccatttctgcagattgtttgcttgtcttttcctgttttttagttctgcgtgctacattgtaaatggtcctcaatgaaccatttccaaaggagaggcaataggatgatgtgtgtcttggaaaccatgtcatagcaagaaacgtcgaagaaactggaaatgttgccctgatgcacagaaaactttgacagaggctgggcgcggtggctcacacctgtaatcccagcactttgggaggccaaggcgggtggatcacctgaggtcaggagttcgagaccagcctggccaacatggtgaaaccctgtctctactaaaaatacaaaaaattagccaggcttggtggcaggcacctgtaatcccagatactcgggaggctgaggcaggagaatcacttgaacccgggaggccaaggttgcagcgagccaagatcatgctattgcactccagcctggccaacaagagtgaaaccccatctcaaaaaaaaaaaaaaaaaaaaagaaagaaagaaaagaaaaagaaaaaaaagaaaactttgacagatcctttagtacacaaggatacaggagaatcaagcctattctgtataacttcagaactcagaaggacttaaggacacaggaagccgcacgttttggttcaaaaaacttttgtaaccattaaacagcctcataatggaatggatatttttgaaatgaagtgagctccctgcctctgggagtgtctaaatggaagctggatatccctctgtccagactgcagctagaatgtcttctacgtgtacctaataaatgagttctacacaaccttccagtgctaaggtctcagaagctatcaaaccacagggaaggaaaaaaaatgaagaggcactgagaaaagtgacaaaccactaaaaacagcccctaaagtaccttaggcactgctttacctctcttctaaccatcatccctgtaataatatctggaaactgcctaaacaagtgttgacatttagttgatgaattaaggcaaaacgctgtcctagagtgtgcacctaagagatttctgattagtagaatttaagttacactagaggacagggaatgatgaatttatcctgacaaagtactgtattcactccaaaagaaatttaccaaaataaatgaacacacgaatatataaataaatagttttactttaaatgcattatttttttctcttagggaaataactggcttatataaaggacaatgtgtatatggtgtgtatgtttaaggcgtgcttcaaggttgctctcaagctgagccagaactatcacgagaagagtgaaaggagcacccgggacgcagaagttaaggaggcagttactcctagggtcctgtaagtgctggcagggtcagcccgtgagagtgagtgcctctttaaatttgcgtcacagacgcctgcttacctcaccccagtccaagccctgtgattggtcaggccatcaaagcctcgccccctacacgacccggaattcgacgccaacactggtttctggggcaacttctgcgtagctatgtgactagcacccggaaataattgccaccgccatcttttggtgcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcagcagaggcagtggctggagtggccccttcggccatcagggaccgagagcagcaggctcccgtgaaccaccactctgctttaaaataaagaacaatatggttggtgtggtcattggttacagtggatcaaaaataaaagatctacaacattcgacaaacactaaaatacagatcataaacggggaatctgaagcaaaagtcagaatttttggcaatagggaaatgaaagcaaaggccaaagcggctatagaaacacttattagaaaacaagaaagctacaactcagaatccagtgtggataatgctgcatcccaaacccctattggaagaaatctaggcagaaatgacattgttggagaagctgagccattgtcaaattgggatcgcattagggcagcagtcgtggagtgcgaaaagagaaaatgggcagatctaccaccagttaagaaaaacttttacatagaatccaaagcaacaagctgcatgtctgaaatgcaggtgattaactggagaaaggaaaatttcaacataacgtgtgatgacttgaaaagtggtgaaaagcgtctcattccaaaaccaacttgcaggtttaaagacgcttttcagcaataccctgatcttctgaaaagcataataagggtagggattgtaaagccaacgccaattcagtcacaggcatggccaattattctacaaggaatagatcttatagtagttgcacaaaccggaacagggaaaacattgtcctatctaatgcctgggtttattcatcttgattctcaaccaatatctagagagcaaaggaatgggcctgggatgctagtccttacacccactagagagttggctcttcacgtggaagctgaatgttcaaagtattcatataaaggtctcaaaagcatttgcatatatggtggtagaaacagaaatggacaaatagaagacattagcaaaggtgtagatatcattattgcaactcctgggaggctgaatgacctacaaatgaataactctgtcaacctaagaagcataacctacttggttatagatgaggcagataaaatgctggatatggaatttgaaccccagataaggaagattttattagatgtgcgcccagaccgacagactgttatgacaagtgcaacttggccagatactgtacgtcaactagcactttcttatttgaaagatcctatgattgtttatgttggtaatctgaatctagtggctgtaaatacagtgaagcaaaatataattgttaccacagaaaaagaaaaacgagctctcacccaagaattcgtagagaacatgtcacccaacgacaaagtcatcatgtttgtcagccaaaaacatattgctgatgacttgtcaagcgacttcaatatccaaggcatatctgcagaatcattacatggcaacagtgaacagagtgatcaagagcgagcagtagaggactttaaaagcggaaacataaagatactgattacaactgatatagtatcccgaggtcttgatcttaatgatgtcacacatgtatataattatgatttcccaaggaatattgacgtatatgtacacagagtagggtacattggacggacaggaaagactggcacatcagttaccctcatcactcagagagattcgaaaatggccggtgaattgattaaaattctggacagagcaaatcagagtgttccggaagatcttgtagtaatggctgagcaatacaagttaaatcaacaaaagaggcacagagaaacacgatcaagaaaacctggacaaagacgcaaggagttttattttttaagttgaaaagttgtaccaggctactggaagattccaggcatgttaaagatatgcagtattgaatatatgtaaggaagtattggaaacatactagccatttgaagacataactaattcttaaataatactgctaaactttcaatattgtgtatgctccttaattttaaaaaagtctcaaaaatgagagagtgagagactgtgtgaagagaaagtgaatgttacgtgttggttaaagtttaatttctcttaaaaatacttttattttaggtttgggggtatatgtgaaggtttgttaaagaaacacgtgccatgggggtttatcaactttcaatattgtgtatgttccttaattttagaaaaagtctcaaaaatgagagagagactatgtgaagagaaggtaaatgttatgtgttggttaaagtttaatttctcctaaaaatacttttattttaggtttgggggtatttgtgaaggtttgttaaagaaacacgtgtcatgggggtttatcaactttcaatattgtgtatgctccttaattttaaaaaagtctcaaaaatgagagagtgagagactatgtgaagagaaagtaaatgttacgtgttggttaaagtttaatttctcttaaaaatacttttattttaggtttgggggtatatgtgaaggtttgttaaagaaacacgtgtcatgggggtttatcaactttcaatattgtgtatgttccttaattttaaaaaagtctcaaaaatgagagagtgagagactatgtgaagagaaagtaaatgttatgtgttggttaaagtttaatttctcttaaaaatacttttattttaggtttgggggtatatgtgaaggtttgttaaagaaacacgtgtcatgggggtttactgtacatattatttcgtcacccaggtattaagaccagtgcccaataattatcttttctgctcttctgcctccttccaccctcccccatcagctagaccccagtgtctgctgtttccttctttgcgttcataagttctcatcgtttgcttcccacttataagtgagaacatgtggtatttgagtttctgttcttgtgttaattttatagtctaccatgtccatttgtcttctctaaaacacttggtagaagacaacaatggtgcttttctggctttaaaatagttgtactaaattgaagcatagcttcaagcttatccagtcaaagtattctcttttcccccgagcagttggtgccacaacagttcttaaagttatttccactatcattctctacttgttttagttcattagaaaataagtgctaaattttttagaagattccacaattctatttttatcagaatgatgtcaccagcagagcaggatgtctgactcactgggattcaggtccttgtatgcattttgtcactaacccttggttaaaactctgaggaaatcacttgccttctctaggcctcaatttctctactcataaaatgggacagttttattaatttagaggtctcttttacctctaaaattcggtgacattataactaaaactgtataccccagccttgtattaacacttttttgtctaatctaggggaaattgcatccttgtataattgaataaaacaatccttttcaatgacaagaatagtgcattctgcatttttattgattttgcaatttaactggtaggttttcattttattctttgcttttcttttcatcatgctttattttaattcaatttgaaggtcaaaaccatatatatatagatacatatatcggggaaaaaattaaagtgaaagaaaaatttatctactgggaaaaacattaaaaccaatcaaataagggctgggtgcggtggctcacgcctgtaatcccagcactttgggaggccgaggcgggcggatcgcctgaggtcaggagttcaagaccagcctgaccaacatggagaaaccctgtccctactacaaatacaaaattagctgggtgtggtggcgcatgcctgtaatcccagctactcgggaggctgaggcaggagaatcagttgaacccgggagggagaggttgcagtgagctgaaatcgtgccactgcactccagcctgggcaacaagagcaaaactctgtctcaaaaaaaaaaaaaccaaaaaaaaaaccaaatgacgtttttgccataagaaccaattttagtaaaactcttcctaattttatctataattctacctcttatgccttatttagaagcaaggtgcttctcacacctgcaaaaagaaatccctacaaagatgttaagtaaactttaaaattcagtgttcatgaaaacattagaattagttaacatttctggtaaaatcaagagaaaaattaaggcaacaaacttttttccccagcatgccttacctgtgactacaaataagtcagaaaataagggaaagaaagaagtaaatgttctaggtataggtatttaaggcttaaagtatagactttaaaggctttttaaaatgtagaccttaatatctctggataaaattaataacaatggttaacattgttgagtgatacatacctggcgctttatctcctaatctctaatatttataagaacgccactcggaaggaaatcttacccctattttgcaggggatgaagcaaagtcagaggagctaacttgcctaagggccctaaacctgattaaagagaaattaagtgatatttagaggacttaagggatattttgacccggcagtgcctgattccaatatttatattttttaattttagtatagttattatgtttaaaggcaatatgcttgtcttgaggttctctacaagttcagatttagtgaaatagagaagtgtgtgcaaatttaatgcaaaggcaatctatagcagaactgtaatagaagctcaaatggcttagtgctgttcactcaagaggagaaatgataaatgtttagcaagttagagtatatgttattttccagaattattcttaggggcaatgctatatttgttagaaaagaatgcaacaactcaaccacttgagatagtatatttccataatcatgtgtaagtaacacttaacaagaaaaattatcactcaatgtctatgagtaaggaaatgagagatgtatgcatttcttctacaacataatgctggacagaagaaccagtgtatagagaaagataagtagaaatagtgcaatgactgttaaccaagggtgattttgctccccagcggaactttgacaatatctgtggacagtattggttgttacagctatgggtagggggtgaggtgctcctagcatctagtgggtagaggctgaacaccctacaatctacaggacagcccctcacaacaaagaattatctggcacaaaacaatagtgctgagatggggaacccctgagacagcataagaaaaacaaccaaaaccaactgcttagtaaccaaaaaggcacgtcaaagaaaaaaaaaaaatagagggtttctaagttatatcttgcgggttttgcagagaaaaagtatccctacaaacttcctgtctttggtgtagtctacatcagtggttctctaccaggcccaattttgtcaatgtctggagaaagatttggtgggttgttgtcttagtccattttcatactgctatgaagaaatacccaagactgggtaatttataaagaaaaagaggtttaatggactcacagttccacatggctggggaggtctcacaattatggtggaaggtgaaggaggacaaaaggtgcatcttacatggtgagcaggcaagagagtttgtgtaggggaactctcatttataaaccatcagatctcatgagactatcatgagaacagtgtgggaaagacccaccctcatgattcaattacctcccaccaggtccctcccatgacatgtgggaattatgagagctgcaattcgagatgagatttgggtggggatgcagccaaaccatataattctgtccctggcccctcccaaatctcatgtcctcacatttcaaaaccaatcatggcttcccaactgtctctcaaagtcttaactcatttcagcattaactcaaaagtccacagttcaaagtttcatctgagacaaggcaagtcccttccacctatgagcctataaaatcaaaagcaatttagttacttcccagacataatggaggtacaggccttgggtaaatctgcccattccaaatgagagaaattgcttaaaacaaaagagctacaggcccatgcaagcgtgaaatccagctgggcagtcaaatcttaaagctccaaaatgatctcatttgactccaggtctcacatccaggtcacgctgatgcgagaggtgggttcccatggtcttgggcagctctgtccctgtggctttgcagagtataccccctctcccggctgctttcatgggctcgaaatgagtctctgtggcttttccaggtgcacggtgtaagctgttggtggatctaccatcgtggggtatggaggatgttggtcctcttttcacagctccactaagcagtgctctagtggggactctgtgtgggggctcccaccctacatttcccttatgcactgccctagcagaggttctccttgagggccctgcccctgcagcacatctcggcctgggcatccaggtgtttccatacatcctctgaaacctaggcaaaggttcccaaacctcaattcttgacttctgtgcacccacaggctcaacaccacgtggaagctgccaaggattgaggcttgcaacctctgaagctgcagcccaagctctatgtcggtccctttcagccacaggtggcatggctgggacgaagggcaccaaatccctaggttgtacacagcaggggaacactagacccagcccatgaaaccattttgtcctcctaggctccagatctctgatgggagaagctgccatgaagacctctgacatgctctggagtcattttccccattgtcttgggaattaacagttggctcctcattacttatacaaatttctgcagctggcttgaatttctcctcagagagtgggttttgcttttctatcacatcatcagtatacaatttttctgaacttttatgctctgcttcctctttaaatgtaagttccaattccaaaccatatctttctgaatgaataaaactaaatgtttttaacagcacccaagtcacctcttgaatgtattgctgcttagaaatttcttctgccagatgccctaaattatatctctcaagttcaaagttctacagatctctagggtagggacaaaatgccatcagtccctttgctaaaacatagcaagagtcacctgtgctccagttcccaacaagttcctcatctccatctgtgaccacatcagcctggactttattgtccatatcactatcagcatttcggtcaaagccattcaacaagactctaggaagttccaaacctttcccacatcttcctgtcttcttctgagccctccaaactgttccaacctctgcctgttacccagttccaaagtcatttccatattttgggtatctttacagcagcacctcactctactggtaccaatttactgtattagtccattttcatactgctatgaagaaatacccaagactgggtaatttataaagaaaacgaggtttaatgtattcacagttccacatggctgaggaggcctcacaatcatagcagagggtgaaggaggagcaaaggcaagtcttatgtggtgagcaggcaagagagcttgtacagggaaactcccctttataaaaccatcagatctcatgagacttattcattatcacaagaacagcacaggaatgacccgccccatgatccaattacctctcaccaggtcccttccccgacatatgggaattatgggagctacaattcaagatgacatttgggtggggacacaaccaaaccatatcagtcgtcataactgggggtgatggtggtggtactggtatctcctgggtatagtcggaggatgccactaaacatcccacaattcataggagagctccctaaaacaaagaattatctggcctgaatgtcagtagtgccacagttgagaaaccttgcaatggattaagcaaaaataaaagcgcaaacctaggtgtagagaagccaagaagggactttatgaaggaaaacaaaaagaggatattcatttgttgtgcactgcgcaatacaaaatcctccactggctgggcatggtgatgcacgcctgtaatcccagcactttgggaggtagaggcgggtggatcacctgaggtcaggagttcgagaccagcctcactaatatggtaaaacccccatctctactaaaaatacaaaaaattagccaggcgtggtggcgggtgcctgtaatcccagctactcaggaggctgaggcaggagaatcgattgaagccaggaggcggaggttgcagtgagctgagatggcgccactgcactccagcctgggtggcagagcaagactctgttaaaaaaaaaaaaaaccctccactaactttcctttctttggtataatctgtatttctcagctggagttgattttgctccctaagggacatttggcaatgtctggagacaattttagttgtccctactagggggcagcattgctactggcatctactgggtagaagtcaaggataaacaacttaaaatgcacagcacagtaacttaaaacaatggatttttcagtccagaacatacagtgttgaggtcaagaaactgattgcattgattgaccagtgaagtttttgtgtaagtaaactgtgtttcagaaattcaaagaaatacttagttctacatacaaattgggacagatggaaagcaaagctctgaatatacacaggactcaaagtacgaggattcagctgacctcagagttgtgcataagattcttagcatggtgactcacattcagtaggcattcaacaaatattaggtcccttccaccttccctctcccatcacctactatatataatacttgttaactattctgggtgttgctcaagctgttttcccccatttggaatgccctttctctttcctctctgccaagacaaatcacctttatctttctgggtccagccaaagtgccatatcttccctaagttcctatctactctccttcattccaaaacttctgcagttacagttcttgttatcaaagaataatgttgacatttacactatctgcataggaatctagtaggcaataaaggtagaccgttttaaatcagtgaagaaagaaaaatctattccaaaccaaataagtaaaataaataaatgaaaaatacataatatatagcaggacaattgatcaaccaaaaaactcttactgttagaaaataattcccacaagattattgcttttataaaaaacaaaagaacatcaagtttatagagagaaataatttctgatatcaatgtggaaaataattttaaaacagtaaagcaaccacagaaaattaaaagtaaatatgaataggtttgataaagtaaaaatgaaaatcttcttaatgttgaaaatatcatcaaaggcaaaggaaacaccagaaaaataatttaaaatatataatatgatcatagttatttatattttatatatggagctttttacaaagaaaaagtaaaagatgaataaatatgggctgaaatgtaaaaggcaactcactagacaagtgaacaacatatatattaaaaagtgcttgacttctttataatcaaaggaattaaaattaaaccaatatgtaacttttctctaacaaattgggttaaggttctttttaagggtctaatgctacaaaggatgcagggaaataaacactgataaattaaaattcgatttaattctattctgtgaagggacagttgagattatacgtataatctgtatatgtttaacagcctttggctcagtaatattacttccagacatttatcccaaagagataatcagatatacataccagtatttataaacaaggctatttatcatagtgttaattaacataattttttttaatcctcaaggtccaatgatatgatactagttaaattgtagcatatctgttcttgatttggaatagcagaaatcatgttcttaacaaatattttaaaatataaggaaaagcagtttataaaatgatctcgattgtttttagaaaactacattggtccatatatctatataaacaaaagcaaatgaaatggacacacatagacacacacactaaccatggttttctacattatgggattatagatggttttgtttttgagatggagtctcactctgtcgcccaggctggagtgcagtggcgtgatctcagctcactgcaacctccacctcccaggttcaagcaattctcctacctcagcctctccaggggctgggattacaggtgcacaccaccacaccaggcaaatgtttgtatttttagtagagacggggtttcaccatgttggccaggctgacctcaaactcctgacctcaagtgatccacccacctcggcctcccaaagtgttggaattatgggcgttagccaccgcgcctggccactagatggttttaatatttaccttattttctaaaatttctataaaacaatgttacttttattataataaaaacgtcaagcataacttttgaataactgcttcaaaagtaacttaatgaataattaaatgactgcagaaattaattcaacaggcattgtatctgagggtatttaaaatacaagcatctcttgtctttcccccacttaaatgtaaatgccactaataggagatatcttttttctaacactgcatcttttttttaacttttaagttcagggttacaagtgccaggtttgttacatgggtaaacttgtgtcatgggagtttgttgtacagattatttcatcacccaggtattaggcctagtacctattagttatttgtcttgatcctctccctcctcccacacgccaccctccaaaaagccccagtatgtgttgttcccctctgtgtgtccatgctaacactgcatcttaagtgctaaaaacaatgcctcgaacatagtaggagcacagtaaatagctgaatgaaaataagtacattattttattttcattgagcaaaagtaaacttttctatttctgttacttgttttgtctgttgacaattgttggcctacacctcaccttataataagaaataatatatgttgtttgtgtcttttacacaaggcacccacataaaagggacacttttatcttattttacagatgaggagactaatgctcagagaggttgcataactttcccacattcaaaaagtgagtaagtagagcttgctatctctgtgctgaaaattatagattcaatgaagaagcgacctagagtacacagaaatataggagagatgagaaagacattattaggcaaagcacacagacatctcagtttacagcaaaataagaaccctgtaaaggtatttttcacactatgcaatgtttttaccactcttcttctcgggccttaagcgtctctgcagctttctagcactagagaaacccgcatggtaaactgaaagcttaaaatgagagaattacaatcactgagtaatcagacttttcacaagtcctttttaaaatattagtctagccgggcgcagtggctcacgcctgtaatcccagcactttgggaggccaaggcgggtagatcacgaggtcaggagttcaagaccagcctggccaagaaggtgaaacccggtatctactaaaaaatacaacaaattaaccaggtgcagtggcaggcgcccgtaatcccagctactcgggaggctgaggcaggagaatcgattgaactcggagggcagaggttgcagtgagctgagatcgtgccactacactccagcctgacgacagagtgagactccgtctcaaaaaaaaataaaataaaataaaataaaatattagtctaaatggtttggttggatatctgctcacgtggcatttagtaaactacagaaccatgacaacaataaaagaaaagtaagaaatgatctgaagaaagactgcagtgaagcttcatactgctggctgggggaagggatacgaatatttggggcatgcaagataagcaaaagaaactgccagtgtaacaagtcataaatccaggctcaatttataacttctaaaatctgaatttttctgggaataaaattatgaagtgccacattagccatatttagggtggcagacactggtggtttacctacccaacagctacgcccaccacctccctcttatgtcccttcctacttgctggcataacccacttcctgttatagaggttacaaaagccagacattcactttcctagcctgccttacagataaagcatgggtatgtgacaggaaagtggcctacggcactgacaggaaagtctgcttggcagttttagagaaagatctctctcccttacaaacagagacatgtgaggtccttcctgcttttgtacagttgtgtgaagatatgaggctgtgacagtcatttttagacaatgtagaaataaatttgaagaagaatactagcatgctaagtatgaccacatggagatttggaaagcagctggatcacataactgtgctgctgaattaaactctatgtggcagctatggaggtgtgcagctcatctccattcaagaaaaagcttgctgatcagctgtgtggagtgcagttagctgacagcccccaactgcagacaatccttggcagcatctgagccaaggctagccttttccaggaagtctcaaccaatagctgagcacagtgagacactggggcccagtcatttctgcccaacactggactcttctatgggccatatttgcagcagagctccccgttaggctcaccctgatttctcagagcctcagtgcagttttaggctcttcctacccagtcctcctctctttaccttctactttcacaggtatcagatctgagctgcagtcagaaggatttccctgacctcttgatacttttcctctttatctttcataggtgttacccccagtaaatattggacccaagcaatatacccaggaatcccctatctatgaactttgtattatataaagcaacagatatctttattgcttaagtcattattagttattatattactggcagcccaaagtatcctaactgataaattggaaaaatagccataaaataccttgtgtggaggctgtgaattttccatcattgagaagagggtccaatgaggtatactttatttggatgagagttgactataataagcaaattaaactcttctcttggatgtttatttaatggggacactgaaaacacaggattctatagggaattactataattttataaaaattggaagcatatcaaacaagcccagcttttgaacagtcagcagcaattagaggaagaagtgagaaacaagcagagtagaaaacttgagctgcagtcatgaagagacccaatatcaaggtcatctgatccaatagcgttaacagcattcacacttggctgcacctggaatacatcactggctctgacagatttgaaatgtagccaaccggagaaattcttgcaatcaacagcctagaggggctcagggtgaacaattctacctaatggagatatatagcccaaagcaataggaatcttctcatgaacacaaggaaaattttttaaaaaaccttttcatatagaagaggaatatggagacaggaattgatgggccatgtttgttttcccacctaagcctgaaaatccaattaaaaaaatagaagagcaagtatttctacaagaatattgtgaaagtcagcaaaaacatttctctccctccctcctcctttcctgcaacccaagtgtccttccctttaaaaaaaaaaaaaggtaattcagaatttcttggtgtattgattggataaaaatctataatgaaaagatgaaaggaggactggtcttctctccttatgctgactcttccatttcactttccaattgctgctaaagctgttcagtgccattcaaattcagaaaactaccacaatcttcaattctgtgtgctcctcacacagcacatagacaataccaaaagcccgtcattgttttcacatttcatgtaaatgtcagtcccctcttcagataccctctcctactgcaaaattctgtttctgttttcttctagctcttccaatggggtaaaatgtctgcgatgatgtttacccagcttaaataaagtctatccaatcttcctaagcttgcaatatgtggcgaacttttggcagtaagtataccaatgtgttctggggtcctaattaaaatttcaattggaacccatttctcatattcagcaaaatccctctgaagtccaaactaactgactttaggcttatgccctgtgagaacctatatgccattttacataaatgttttaattttctctgcaatcaataaatgtggctttgtcatatcccttcccaggcatttctgtttttgttctctttgtaggcccttcctgtaacacacacgctattttatagtgccttcccatcaagtaccatatgacatttcattctaatttaactctgctgtctcacagataagagaatgttaaatgatggtaactaaaggggataagtgttttctacttctggaaaagggtctcctccttacccacccttctacaacacatacacaagtgtgcaacacatacacatatattacacatgcatacactgtgtgtccagtttagctgaaaacacatagcctgccttttacctcccccaaacctcattctgtcattcagagctcggaacagcatgcacagtatgcagagtaagctgaacttactgttcatgtagataagggaaaaagatctccccctttccttttcagaagataccagttgctgcctccagattcaagcataagataatagttaagggcatagtctccggagtcagaaagacctgagcctgagtctctgtttggccagctgcagtcagttacgtgagtttgggcaagttatataaaggtcctaagtcttggtttactcagctctaaaataaggacggtgattttaggctgggcacagtggctcacgcctgtaatcccagcactttgggaggcagaggcgggcagatcacgaggtcagcagatcgagaccatcctggctaacacggtgaaaccccgtctctactaaaaaatacaaaaaattagcccggcgtggtggcgggtgcctgtaatcccagctactcgggaggctgaggcaggagaatggcgtgaacctgggaggcggagcttgcagtgagccgagatcgcaccactgcactccagcctgggcgatagagcgagactctgtctcaaaaaaaataaaaataaaggccctaagtcttggtttactcagctctaaaatatggatggtgattttaacctgtgcttcatgaagacttgatgatatacatataaagcaaccagtataaaaagtattatactcaataggttttttaaaacaaaaaatggtaagataatggtacaggccaattccacctagttgtcactcacaaattataaatgttaatgtctcataaataaaagaatttcaaaaacatgatccttttgttttcggagttgttcccatggggaggacacttatttggtccatctgtggaagatgtatgttttccacttatttggtccatctgtggaagatgtatgttttcgacctctgctgttctctgcctgtctgcttcattctcctccctctacaaagtgccttttgctgtttctgcatgcacgtgatggaatatggctgattccatagctccctgatctacattacttctgtcaatgctatcaatatagattgaggtagaatgtctggctccaggtttatatttctttatgagaggaactgattgctccactttggatcaggtatctactcatggtccaatcaagtgttatgggtgagagggctagtggtgacagagccctctagcacaaccatagctgctaggacctcaaccctatgcttgagggaaggtaatcttcagaaaaaggggactgtagaagctatagtattacattggttttcttatgaagaaagctcatatatatttattattttatgaatccagttatcacttctagttgtcatgcagagactgttaaagttcttttttagcatttctttgaaatatgaggattttcatgctatctggataatcaattcattggtatatacattattatttattttatcgcacattttatctaccccattctttttggaaacttttatacaatcatctgacaagcaatagctacttctaatgaattttaataaccattttccaagaaggatagcactcacaatactatgcatatcatcattatctaccaagcctattctttataaaatctgaagctgttcaattaataaactttcatgtctaaaataagacaaattataccacttaaatttatttgcccccaaaacacttttacatgaaactcagtttcactatcatcattatcatatttagatatttacattttagcaataaaaatacatgttgacttttacacttacgatttagataagatgaagatatttcttggcactatttatttttcatatcatcctaaaccacaaagaaattgatttaggataactctctcaaatatgacaaagttttttttttcttatttactgcatgtctaattcattatcatttcttttcatttatcattgatatggtatcttaatatatcagttttctatgttgagatttaagtagttcatatagaaaactaaataaatattaatcatattggctgcttcagaaaatcttagaatacaatattgaatatgccagaaaatataaatattaatattgtacaaagtattacttgagggtcaaagaacttagaagagaaggaaaataaattattattatgcagttaaatttgtactaaaccattgggggaaggatgtttcaaagacaaaatttgctggttcagaggaaatgtttcatggaatttttttgccagatatgttttttgctctcatctagatggctcctattttttgagagatattcgatcataccaggcgtcatggtagggctaggagttgaaaggtttatatagatctgtcaaccccaacactaaaccctaaagtttcctaattcaaccgtagttttgtgaagagaaaagaagacatggctcagaccactgggttttggccagggccaatgatctccacttactggagtcaaggctcattatttattcagaaacctaattctgtaggctgtcatggcaaaccaagatgcttcttgagccctcagttagacctacatgagaaatttgtgctcttgtgaaaaacctagtagcaaagggccgggcgctgtggctcacgcctgtaatcctagcactttgggaggcagaggtgggcggatcacgaggtcaggagttcgagacaatcctggccaacatggtgaaaccctgtctctactaaaaatacaaaattagccgggtacggtggcacacacctgcagtcccagctactcaggaggctgacgcaggagaatcacttgtacctaggaggcggaggttgcagtgatctgagatcctgcctctgcactccagcctgtgtgataaagcaagactccatctcaaaaaaaaaaaaaaagaaagaaagaaaaacctagtagcaaagacacagcaactagctgggcttcacagactagccaaaagttcttcatcatagaagttgccttacatagcagtagcaaaatgagaaaaggtgcatgcacaaagccctatgtttagagtggtgacaaaacctctgaagtaaggggtctccggcaagtatacacatcccagtctggcacctatctcccaattcatctgactctggagtgtgcaaagaaagcattcgttattttgccaggaatcccaccatttgaccaccttgtacctcagtagatcaggggcctcctgggatgtgaccaacaaataactaaccattgtgacactggtgtctaaccatgttcctgacactattgataagagaaatactataaagcagggctaggtctcttttctgcaaccgaggtagtgaaaagctttccagctttgaaagcagaaagatctgggttctacagaagttccatcatgttatttataattttttttctttttaaataacaaaacatacataaaacatttaacaaataacaggtgtatatatatatatatatatatatgtaaatttacagaatgttcatactttgtcatatttgttttagagtttattttgttaagaaattaaagactatagagatttaaaattctatgttatcctatttccctcctttgtactccagtggtaactactctcctgaagttggtatgcatccttcccatgtgtatttttatttttactatgtagtattgttattcatgttctcaattttatataaatggtgtcatgccatatgaatctttttgaaaatcttctttgctcaataggtagtgaaatttatcaaagctgatttattaatatgtagatctagttcatccatttaaatttgaatagcatgccattctatggctatttgagtatccattactctatacatagacatgtagattatttgtagtttgggactcttacaataatgccgtagtgaacatggttagataagttcccttgtgcatgtgtgtaggaatctctcaaaggcatataaaggattgattttcaagtgaaatagaccaatatgaccaacccggtcatttacagtatatgtttgttctaattgattggtacccctgagagcagttgttaaatattttgaatatcaccccttgatacatacctagaagtatcactgctgggtcatatagaatgcacattttcatctttactagatatattgcctgtagctctttaaagcggttcaactaatttacactccaagcagtagtttaatatgtacattcctatttccctacaagtggaattgttaggctaactttcactggtctgatgagtgtgaaatggtattttgtaggattttttttgttttttttttttctcccaagatggagtcttgctctgtcgcccaggcttgagtgcagtggcatgatctaggctcactgcaacctccgcctcccgagtttaagcaattctcctgcctcagcctcttgaatagctgggattacaggcgcgaaccaccacaccccgctaatttttgtatttttagtagagacggagtttcgccatgttggccaggctggcctcaaactggctggtctcaaacttctgacctcatgatccacccacctcagcctcccaaagtgctgggattacaggcatgagccactgcacctggcccatattttgtagttttaatttgcagtttcctaattaccagtcaggtgaaacatcagctgtttatcagccattcagaactattatcttgtaaattgcctatccatagcctttactccattttctatagggctgtctacctttttcaagttgatttctaagtgttctgtatttcttctccatattagtcctttgtcaattatatggattgctaacatctttttccggtttttggactatctttcactttctttgttgtgcctctcgatctaaagaatgccaccatttgttagctctatgaatttggataaaccatttcaactctcaacatcttaatttattcatttataaaataaaaccaatagtgccttacttacaatattgtggtgaataaaaataatgacataataaatgtacaggaatgagcaatatgcaataaataagtagaagttttcttcttgcggctctaccctcaaacagaaggggaaacaggggcacactactatgcaaatatattcactgagctatggtatgtcaaaaaagacatcctatggatgcttgaacagaaggattaatcaactggattatattagtcactcaataaacattaatatttattgaacccttcctatgtaccaagcatagaaatagagtgtgatgcaaaacagataaatgcttgttgaagtgggaaagagggagacaacaagaaacaaattattatttgctacaacatcaggatgaagaaagttaaaagttatgtggtgattacaaaatgattgaggggtacaatttcatatcagatggtcagaaaaatcccatcatggaggcaactgaagtagaaacccagaagaactgaggaaaggatcatgtgaaggaagcatatgcaaaggccctgagaccctggcatacttgtcagtcaaggagaaggaggacagtgtagtggaagggaatagcaagagggtgcaggacagggatccagggacaagataatgaccttggagtgcacgataaggattctagattttattctaagtgcaatggaatatccctggagggccctgagcagaggagtagcatgttataatttatgttttaaaaggatccatccaactacaagatggataaaaggctgcagaagtgtaggagagtgagtatgctgaccatggaaagctgcctttcttgcgtggaagattctaaagccattcattctggtcatttcccccaggactcaaaaataagcaactctgaactgaaatctcaactgcagcaactggcattatttctatttactcttattggacaatccatatttaattcagaacctggaaaaacataagaaatactggcaaaaacaaatgacaaaacaattgtgctgaacttgtttacctctcatttgcactggctactttgtgcatttttctttgacttaaagaaatcaaggcgtatttaaaatggttactgcctgtagattttttttaagtgtcaaatgacttgtgtacaagcagtgatttccccatgatttttttctggggggaggatgggggtgggtatcattacctagtgacatggagaggtcatacctaaccttccctctcaagaaatgctggctatctgatcatgaatttttcccaattctttcccactctccaaggtgttctaattgatttttctccctgctgtttagaatctaaggatatttaattaatgggtttcttttacacaaatagaaaaactcagcatgaccaaagtcagaatggtcaacagctaagctcttccctgccttccagctgtaacaccttattaagactgatttccccagccagcctgccaatccacaggtacttcacattgtgttttaaaagtttctgcttctgcattgaaatcaccagtattatttcttaagaaattattcctacagcaggtcttcccaaatattgattgaaaatgaaccacctggagatcttgttaaaatgcagatttgaactctggatctgggatagggtacaggattacgcgtttcccagatgatgctgatgttggtgatctgagggtcacacttatgtagccaggtcctcagctgaaggcaactacagctttaaacattagtaaaatatatacaggtgctcctcaacttatgatgagtttatcttccaaaaagcctatcataggttgaaaatatcgttaagtcaaaaatacataaagagtttgtccataggtagtattttagccctttcccctccctccctcctctcttgtagtactcagtgtctattgttcctatctttacgtctaagtgcatacaatgcttatctcccacttataagtgagaacatgtggtatttggttttctgtgtctgccttaattagcctaggataatggcctccagctgcatccatgttgctgcaatgaacatgatttcactcttttttatgactatatggtattccatggtggatatgagccacattttctttgtccaatccactgttgatgagcacttagattgattccatgtctttgctattatgaacagtgctgtgatgaacataagtgcatgtgtctttttggtaggaagattttcctttgggtataggcccaataatgggactgctgggtcaaatggtagttctgttttaagtcatggtttttctctgagcatcattatttggtgacaaggagagatcaagcctaaactttcaagttgaaaatttgaaaatttatctaactatggtatacataataataatttacaatcttgcattaatagcctaaatagttatttcccctatcatttaagatctttttagacaagggagaatctggcatttgtctttggagggatttctttgaggtcaatagctcacaatgctgaaaagtgttcaatcctcagcactggttctcaaggtctactcccagaaccagcagcattagaatcacctggaaacttgttaaaattccaaatttcaggccccacctaagacctactgaatcagaaatactgtttgtagcacccagatatctgcatctgaacaaacccatcaaacaattctgaattttgagaaccactgctctataagaccagttgctttattttcattactaaataaaacacattccgctgggcacagtggctcacgcctgtaatcccaacaccttgggagaccaaggcgggtggatcacgaggtcaggagatcgagaccatcctggctaacatggtgaaaccatgtctctactaaaaatacaaaaacttagccaggcgtggtggcgggcacctataatcccagctacttgggaggctgaggcaggagaatcacttgaacccgggaggcggaggttgcagcgagccaagatcataccactgcactccagcctaggtgacagagtgagactccgtctctaaataaataaatacatacatacatacatacataaaaccattcataagattttcttaaattgactgtataagactgatgtttaaaaagccccacaacccccataaattctatctgcatagtgtttggcacatataaatgaaataataaatacaaatctggcataagggggaagattagtataggtttccccacaatttacaatatatcctctttcttcactaatgtagctgttagctattcattgcataaagaaggaatcccaaaatgtgacacagacattaacatttaaaaatttaggcaatttatagcaagtagtaaactctcaggaggccagtttgatattgctttgagggccacttttttttttttttttttttagagactagtaattgtttcttttttttttttatactttaagttttagggtacatgtgcacattgtgcaggttagttacatatgtatacatgtgccatgctggtgcgctgcacccaccaactcgtcatctagcattaggtatatctcccaatgctatccctcccccctccccccaccccacaacagtccctcaatttcttatacaaagaatatctaggcattgttcttttctcatttcaaagtttattcctcctcggaagaatccatttgaaccatttcttctgtataattgactatttatatgcaggtattactggcgaactttaccctcttgagggccactaaccatgcctgggttacttttatgataaaatgtcactaggagatgagaatctaactatggaaaaactccaggctggttttcttaagacttccatgggaaaatgtcagcaggtccatgcatgggcctacttcagtcctgggctccaccaaaaaaaaattactcatcacaagtaattggtaaattctaataaatttctaagtgagagagttcccctgagtttccgtcaccacatttagtgctggaagtggtcttggaaatagctagaaatagtttcatgtcatcatttagaattagaatctgtaatattttaacatcaaatgcacctcataaatcacaaatatccctacactgcatttttatctagacttttttgaaaagttacattttatgtcctaacttttacaaccttacattatgagttttcaacatttttatctgctatatatatactcattaaaaagaatttaatatcctgcgcattgacctattaaatatcctaacgaagagagtaaattaactgcttttgtaagaacatgaagaatattaataaacaataagcaaaattgctagtaaatttgcaatggccaactttatatgtcaacttggctgagccatggtgctcagatatttgatcaaacattattctggatgtttctgtgaaggcatttttttggaagagagtaacatttcttttttgagattgtattagtccattttcatactgctataaagaactgcccaagactgggtaatttacaaaggaaagaggtttaattgactcacagttcagcatggctggggaggcctcaggaagcttacaatcatggcagaaggtgaaggggaagcaaggcacctttttcacaaggcggcaggaaggagaagtactgagtgaagggaaaagagccccttaaagaccatctgatcttgtgagaactcactatcacaagaacagcatggaagaaactgcccccgtgatccaattacctccacttgatctctcccttgacatgtggggatcatagggattataattcaagctgagattggggtggggacacaaagcctaatcatatcagagattaacatttgaattggtgaattttgagtaaaacagattaccctccataatgtatgtgggtctcatccaactggttgaagactttacgacaacaaagactgacctccctcaagcaagaaggaattcagccaggacacttcctggggattcaaactgcaactcctccctaagtctccagcctgcctgcttacctcatcagattctggattcaccaagcacccacaatcatgcgagccaactcatcaaaataaatcttgctcttgcttactctctctctgtctctgcgccccccatctctacacacacacacacaaacacacacacacactaaaacgcaaccatatcctgttggttctgtttctctggagaaccctgactaataaaaaactgtgaaggataattttaaaaggtaaaattatatctctcatacaaatataaaatgatcatttgtcagaaagttttcccaggaaactaatgtatctcacagaattgctgtagtctacttagcatgcagtgatgttctcaataaatacacactattaatatattactccaagcagattcatttcaagacatagataatatttagggcccaatctcctcattctgaaactttgttccaagtctgtcttttggacatttttttcttttccttattaaaatctggacatactatgaaattctttcacaattagatgataatatagaaaagttttcagtgataatagaggaggcagcattcaagtgaaaaaaaaaaagactttaaagaaacaaagtgctagtgttgaaatttcaaacatcaactctggagttgtgaaggtgtttctaggttaagaaattcttcctgagatccccaaaaccacatcccagaatatgtcctcctactcctagaggtaaggtgaggcctgtgggttctacatagtatttgtgtatacacagacacatgcacacatacgtgcgtgtgtatatacttctacataaaagatagcagcaagaatttatatgtacaaccttaccttttcttttggcacttaataaaaaccagtctactgagtttacctcacagaatccccaaagagaaaacattccctgtaaagcagccattcctgttgtgcttatttactgatccatgggcaatgctcctcccacagagaatttcttcctggaaaaagaaatctgcttttaaaaataaggtagacttttatctgcctggcatatcctcagcatggaccaccctgaagacagggcgataaacgcactaaatgaatctgtaaggagttcccttcttctccttcagtgtggtggtacttaattttttggtttcatacctattgctgccgtgaaaatggtcccccttcttccttgacactaaaagaaatgcccagcagttcattcaagactttgccccagctacagaagttgggaaagtggcattttatcctcttgatatatgttgttttaactcttagtgaaataaatggtttctatattacacatcattattcatatactgaaacgagatcttttctgaaacatctgaaaaagatttgcaatttggatgatcccttatcattttgatttttcttcagctatgtttaggagttccatgtattaaaaattcataaatattcagcatttaggctgcaaggagagcaaagtgtccctcaaaagttcaaattagagaaacggtgctcagtttccacaccaagcagcagtatcaagagctgagtattcataaaaaagtaactgtctctaaaactcataagcattcatattctcagaaaagtttgggctatgggctttaattttgtgttccttaaacttggagtagagtatatactggtctctgtgtacaacttaggtcagattcctaataaaatttcaagtccttccaggattgcatcacagaagagggactgggaaagaatcatcaaagaattcagaaacaagaatgacaaagtgaaaatagggttgcaaaataatatctttgcagagaaacaatttgaaaacttaggaataatttaataatcaacttcaattgctgaatatgatgataatcaagtaaggaataacgactccatttgaaatgtggatcaagctaaagtagcagtattcaactgcatactaatgaatcaaggtggacataaaagggattttccctccaaaataaagatgataaaaccttaacatgtactgtagaagaatgacaaaattttttctattgattcattgacacattcatccagcaaatctgcccggctacctgttgttacctctttctactcatctcctccctccctttccattgcttactctgactcctgtcttactgaccttttctgtcttcaacctcttgacatatttctgcttcagagctttgcaattgctgttcccgctgcctgaaaatatcttcctgcaggaagataactgggtcattccctctcctccctcagacatctgctctaaaaccaacctctcagtgaagccttccctggccaccctctcaacagcttccattacatttccctgatttatctctcttccttagcacataatcactacctaaaatcagtaggtaattttaggtaatacctaatttaggtatacataattttagtagataatacctaaaactgagtagtattccattgtatgaatgttctaaggattttgtagccactcatctcgtgaaaaagacctggattgtttctagtttttgctatcacaaacagccgctaagaataatcctaaacagcttttattgtgaacataaatgttcatttatctagagtaagtacctaaaagggagattgctaagtcatatgtaagtgtatgttttcccaagtggtggcggtggtaccaattttttttttttttttcattccaccagcaatgagtaggactactcatctttggatcctggccagcactcagtatggtcaccattttttattatggccattctaatgggtgtgtagtggtatctcaccatggtttgaacctgcatttctcaatggatgattttgaccaccttctcatgcgaacttttgttatccatatatcctcattgatgaagtatctattcaagactttgcccattaatttgtgtgtggtttctttagctcaatattttttagccttttatgaaatatttaaaaacgtagaaaaagttgcaaaaatgggacatagagttctataaatactttgaccagcttgccttattggtgacatcttaaataactatagtacaatatcaaaaccaggaaattaacactagtagaatactgttagctaaactatcgaccttattcagttttcaccagtttttatgagcaatcatttgtgtgtatgcgtagttttaggcagtttgatcccatgtataggttcgtgtcactgttgacaaatcaagatacagactggtccatctcccagatgaaactccctcatgctactgctttctaatctcaccaatcccccaccctctgttcttgtcctctggtaaccactaatctgttcttcaacttaatattttgtcattttcagaatgtaatataaatggaaacatacattatgcaacctttgagactgtcttttttttttctaaaaatattgccttagagattcatcgaagttgttacatgtatcaatactttgtttctttttattgctgagtagtattccatggtatggatgtgccagagtttgtttcaccaatcacccattgaaaaacatttgggttgtttacagttcggggatattacaaatgaagctgctatgaacattcatgtactggtttttgtgtgaacataagttgtcatctctctgggagaaatgccgaggagagcaactgctgatttgtgtggtaaatgtgtgttttgttttacaagaaactgcaaaaatgttttccagagtgcctgaactattttcgatttcccattgcaatgtaagagaggtcccatttctctgtacccttgctatcatttggttttatcactttttttattttagccattttaatagatgtatatattgtggtagttttaatttgcatttctctaatggtgaatgatgttgaatatcttttcacatacttttttggccatctgtatccccttttcttctgaaatacctgttcatgtattttgcatatattccaattgaactattttttagagttgaattttgagtattcttaatatgttttagctgccagttctttattgtgcatatgactttcaaatgcaacctcccagtctgtggcttgtcttctcgtcctcttaacaggatccctaacaatacaaatgtttttaaatttgattaagtccaatttatcaactttttcttttatgaattatacagttgttgtctctcaaatctcttcacttagccctaagtcctgaagatgttctcctatgttttcttttaagagttttatagtttcgcatttaaacccctgaaacattttaaatttatttttgtataagttgtgaagtttacatcaaggcttatattttcttaacctatagctatccaattgcttcagcaccatttgttaaaaagactgtctctcctccattgaaaaggatttttgcacttttgtacaaaagtacagttggctgtacaactgtggatctatttatagattctatattcaattccactgatctatgtgtacatccttccactaataccatactgtcttgcttactgtagctatataataagatttaatttcttctttttcaaaactaatttagctagtctggctccttcgcctttcgatattaattttaaaataagattatctatctacaaaaaaactttttctgggagtttgctagtaattgtgttcaatctagatttggaaagaattgatatatttattatcttgggtcttctgaatccatgaacactctatggttgttcatttatttagatcttctttgatttcattcatgaattttttttttaattttattttaagttcaggatacatgtgcaggaagtgcaggtttgttacacaggtaaatcttataattttcagcgctcagtctgcacgtttggttagattaatacctactaagtatttcatattttgggggctatcataaattatatgcattttaaattttttcttccataggtttatttctagcatacagaaatgtaattaatttttgcttgttgatcttatatctggcaacctcactgggcttgccttctaagagttttgcaaattttaaaattgttttcttaatgttgagttattataattatttaattattctgaatagaaataatttgttaggtatgtgatttgtaaatatttttccagactttagcttgccttttcattctcttaacaatgtctttcacagaggaacagtctttaattttgatgaagtccactctgttaatttttttcttcaattgttcatacttttggtgtttggtctatgaactctttgcctaatcccacattatgaaaatgtttctcctatactttcttctaaaagttttgtaattttccattttacatttaagtctatggttttcgttttttttttttttttttttttttttagaaggagtttgagtttcgctcttgttcccctccaggctggagtgcaatggtgtgatctcggctcattgcaacctccacctcccgggttcaagtgattctcctgccctagccaagtagctaggattacaggcatgcgccaccacgtccggctaattttgtatttaatagagacagggtttccccatgttggtcaggctggtctcgaactcccgacctcaggtgatttgcccaccttggcctcccaaagtgctgggattagaggcacgagccacaaggcctggcagtctatgctccattttaagttaattttattagatgtgaggtttatttcaaggtttatttttttgcatatggatgtccaatagtttcaataccatttgttaaaaaggatgttttctccattgaactatttttgcacctctgtcaaaaatcaattggccatatttgtatgggtccatttctggactctctattctattgcattgatctattcatctgtttttgaggctaaatgacattgccccgattaccgtcgttttttcatatgtctaaaaaatgggtagtatatttgcttcacctttttactttccttcagatttattttagatattatagtaactttgcctttccataaaaattttaaaatccgtttgtctatatctactctgattggcagcttctaagaagccccccagtgtccccgcctcctggtgttcacagccttgtgtaatttctccccaggtaacttgctcctcaaaacagaattcagcaatgttgagggaatgtcacttctattattaagtttaaaaagaatctgtctgctgtcttgacaacagactctctctcttgctagctttgatgacacgaattggcatgttggggagtcccacatgttagagaaatgagaaaggcctctaggcaacaaccatataggaattgaggcccttagtcaaatagcccacatataactgaatcttgttaataagtacatgagcttgggagtggatccttttccagtcaagagttaagattagcccagcctacatcttgattgcagcctgtcagaaatgtataataggaatccatgtccagattcctgacttacagaaattgtgagataataaatgcatattgttttcagtcacaacattttggggtaattggatatacagcagtaaaaaactaacatatctacaaaaattcctgctaagattttgattgaaattgtgttaaatatatagatcaacttggggaaaattgacatctttactatgttgagccctcaaatccatgaacacagagtctcttcatttatttagatcttctttgatttcattgatcagcattttgttttcaacatacatatcttttaaatgatttgttagatttatacatacatatttcattttttggagctattaaaaatgatatttttcacaaatttcggtttccaattatttattgctaagcaggatataaaaatatgattgacttttttgtgttttgacctagtagcctatgaccacatcaagctcatatattagttctaggaagtctttatagattccccggactattctccataaacagtgacgtcattttggaatagagacagttgtatttcttctctttagatttatataccttttatttctttttatttccttatacactacccagtatttccagtacaatattgaataggagtagtgagagtggacatatttgtcttattcctgatcctatatcacattgagtacactcccttctatttctagtttgctgagtgttgttctcatgaatggatgttgaattttgtcaaatgctttttctatgtcaattgatataactgtgctttttagatttttagattgttaatatgatggaattcactgattaattttcaaatgttaagtcttgcattcctgagacacagcccttttggttgtggtgtattattccctttatacattgttggattttatttgttaatatttttttgaggatttttggatctctggtcatgggggtattaatatatacttttattttttcatttgtactgactttgtatggttttaatattaaggtaatgctagcctcattaaatctattttagaaggaagtattctcttctctgcaattttctgagaggcactatgtacaattggtgctacttcttccttaaatgtttggtaaagtttaccagtgaaaccatcttggcctatagattttctttttggaaaaatttaactatgacttcaatctctttaatgattatgggactatcaggttatttatttcatcttcagcaaacattaatatgcaacttgtaagttttgagaaattctccatttcatgtaaattatgtttgtgtaattgttcatagtattcccttattacccctttaatgtatgtagagtgtgcagtgaaatctcttctttcattcctggatattggtgatatgtgtctttatttcttattaagtcttactgtagtttcaatcaattttagtcatcttttcacaataacaagtatttcattaattttctttattttttgctttcaattttattgattcttcctcttatctttgttcttctttccatctagttgttttgggtttattttgctctttcttttctagtttcataagacggaagcttaggttactgatttttggaacttccctcttctctaatataagcatttaatgctgcaaatttccctgtaagtactactttacctaaatgtcacaaattagatcggttgtattttcatctttgttgagttcaaaatattttctaacttctgttgagacttcctctttgactcatgaagtatttaggagtatgctctttaaattccacatgactggagatttttactcttacctttctgttatttatgtctaacttaattcttttattgttagagaataaattgacataccttttatgatttcaggcctaaaattttgttaagttttgttttatgtcctatgatatattctatcttgataaatgatccatgtacatttgggaagaacgtgcattctcctgttgattagaggagtgctctataaatgtcaattatacactattaatttatgatgtttcacattctcctataactttgttgattttctgtctgagttctatcaattattgagagaagattattgaagtctccaactgtaattgtggtttgttttcaatttttccttcttttttttattcctctgctccttcttttctgtcttcttttaggttgttttaactttttagtgttccattttaatttctctactttttactgtgtattctttttttttttttttttttttttttttttttttttttttgagccggagtctcaccttgttgcccaggctggagagcagtggtgcgatctcagctcactacaacctccgcctcccaggttcaagcgattctcctgcctcagcctcccgagtagctgggattacaggcatctgccaccacaaccggctaatttcttgtatttttagtagagacagggtttcaccatgttggtcaggctggtcttgaactcctgacctcaggtgacccacctgcctcgtcttcccaaagtgctgggattacaagcgtgagccactgcgcccagcccgtatattcttatataatttttgagtggttgctataggaattataacatttatactaaacttattattatctacatagaatcaacgttctaccactacaagtggtctgtagaaagcttttcaccatataagtccctttactctgtttcctttatgttgtaactctcttatgtataacactgacaaatattaaaaacccatcaagcattatagtttttgctttcatttatcaaaaatatttaagtaatgcaataaaataatgagagccaatgatactgacttggatatttgcaatttctctttcttttcgctcctaatgttgcaagtttctttctggtattattttccttctttctgaacatcttcccttagcaattcttccagaggtagttctgctggcaaaaaattctctttatacttcatctgagattgccattatttctgaaggattatttttgcttgatgtaaaattctgggttgataattctcttctttcacaactttgaaaatgttgttccaattccttttgccatccatggtttctaatgagaaatcagctcttggttgaatcattattctctaaaaagctatgtgcctggccaggtgcactggctcacacctgtaatcccagcactgtgggaggcctaggtgggcaaattacctgaagtcacgagttgaagaccagactggccaacatggcaaaacctggtctccactaaaaatccaaaacttagccaggcatggtggcacatgcctgtcatcccagctactaaggaggctgaggcaggaggatctcttgagcctgggagatggaggctgcagtgagctgagattgcgccactgcactccagcctgagcgtcagaacgagactccatctcaaaaaaaaaaaaaaaagtaatgtgccatttttccctgatttttttcaagattctttatttgactttattttccagcagtttcattatgacgtgtctgggtatggatttctttgcatttatcttatttgggatgtactaaacttcttaaatctacagtattgaatctatagtaggtttgtctttcaccaaatctgggaagtttccgttcattgcttcctcaaatattttttctgcatattactctttctcctttcttgaattccaatgacccaaatgttagactttttgttattctcccacaggtccctgaggctcttttcattctttaaaagtcttttttactcaaatgttcaaagtggatcatttttactgatgtatcttctgacctattttcaaattcactgattccttttctctctcgccttcattctgctgttaaattattctggtgagtttttcttttctttaactttggttattttatatttcaattctaaaagtatacacttggttcttctgtatattttcgatttctttgctgaggttttctttccattttttcaacagcgttcatccttacttacttgaagcattttcacaatagctgctttaacgtctctgtcagaacattccaacaattatataatatcagtgctggtatgtgttgattatgttttctcatgcacgtaaaatgatcctagtatactgagtaattttgcattatatcttggacattttgaatatcatattatgggcttctggatcttgtttaaatcatatggagaatgttgatattattgttttagcaggtaattgacccagttaggttgaggccacaagttcttgccagccttctgtaggttgtgctttcaatgtgggttccaatttcaaagccttttcagtgctgattggaactgtccctcatctgcaccgccaagtggccagtctgtgacctaggcagtggtctattcggctgtataggtcctatgtgagcatgcacagtcatcggtgagtttgagagctcatcaagaactttaagaggtttattttcccaaactattccctctccaccatctccccaggacattctggttccctggggctcttgtttgtggtcctctagccagaaatctgaagttttatttaccttaccttggtgcacatttcctgccacctgtgctgtgtttagggacaagtgaccagaagacagagaaagaaaaatttcaataggagtttgccacaccttcttgggatctcagcttctcccatcacagagaaaagttctcctctctcagtgttttaggctactgtcggtttttttctctattacatctacccaccctgctgtcattggattgcttgggctgaggtgtgagagaaaagagaaaagaaaaaaaaagtaggcgattccccaactctgagcattagaagaccattttcctgcttctagagccagaaatagaggtcttcttctggagctctctctctttaccccaagcctgcttccaggttccaggttgccttgtcttcatgctggcagatactgaaggaaaaacgggataaactcactgccagctcagtgctacttttaattcttgtcttctttccgctttcgcctgctactgtttatatttcagacccctcaaatacctgctccatgaattcattccaacttttacagccatattcactgggagacacagagtgaagttgtttactcttatccagtaccagagatccctagacattttatactctttggctctttgtttaggacttactttttaacgcattagactggaaagcctgtgagatcatggattgtcttttttactagtacaattctagcctggcacatagtaggtgcttaatacaatttttggtgaataattgattgattgattaatgaataaatgattaatgttgggttattagtttttcaaactctaaagctattgattcattttaagtagtaattcataatttttacttttacttaactagatagatgtaataccttattaagactcatatttaattcacatgtgtacttgcagttacacaaaaaaatatttttacatttcttacagaaatattcaattatagtaaagtgtaatttcatctgttccagctcctatggaaaaaaaaaagtgacacttttaactacaatataatttatattcaaaagtataataaccaacaacatttcagctaagcagggaaaaataatactagtagaccttacaaaagctattcgaatacctaaaacttaatctgtcctcttagtggcaaatgcttttctttccttgtatacaggaacatgctcacaccatcacaaacttagagatacactttggcaggaatctgcctgtcttttgggtaaacagacattccaattagttagtagctagatttgagctccttatcatgtgacctgtgtgtgacagccattatgcacgatgacttcagcttcttcagtcttgagctgtagcaagaaaggaatagtgcaattgaagtattttttaaatactgctgctatcagcaaagaaatttaatagatccataggctgttacaaagcctatatatatttcacacagaaggtcatgatagtaattcctaaaggacactgtctttcctttatgaagtttttttctccctcagtcacagagacagaaaaaaaacagagcatgaatagagaatgtacactttactccaaaaggcaattcctaaaacacagctcatggtaggttagtaaaggttagtgctttattttttttcttcatttcaaacgtaaaaatctcacaacaaaaagtattacaacaacttacaaataacaaagatgatctaatgtcagtgcataaatggggtctaggggggcaagacacggctaccagtaactataatttcaggctgctctgtagtgttatgcttttatgttctctatccaaggtgactgatataattggatcattatctgaacagagcctagagagattaataaaaaataaatgctgccttttccgtatgatatcttttctccattgaatttaaaaactgtcgtttccgtagttttcttctcctgagtcccttagaaggttgatcatgggctttcttctaggtcaaattctactgtccatgcccctgacactgaactgcacttgcctttctctggcctctactctgaactactcttacctagtaacagttataaactcatagtgtctagaaagtactatctttccagaaaatcatgatatttcactgtatatctcattttaatgcctataatggctttcctgaatgaggagggccaaggtaatcaaaagcaaattaagatacagaaaaaagaaaagttttatggcacattgcatatggatgaaagaagctacatatttgatattccaaatgcttgaccacaaatcagaacatctgggttctagtataaactctgctattgatctgtaactccaagtatgccatttactttccctagaccatttttttaatcttgaaattaaaagtaactataccaatctttttatttggatgaagaaattaactacttcttgaataatagtgactaccctgattttttttttctccctctgaatcaactaatttttcccctggatatctgaagacctgtgattacttaaaaattatttctttattcttaagcacaatgagtgaatcaaaatatgtctcagtgtcattaattgcaaataatttttcctgctatgaagtgtgtttccttaagtttcaagggattatttttctttgtttctaaaaaattttcctctactatatctctaaatcttttctcgctccagattttgtatggaagttttattttcagctgtgtctttctcatttatgtataagctaataacttgtgcttagttctcaatttgcttacttattgttcaatctccttttacatcttactcttttgtatcttcttatctttgtagttctattttaacttgatgaatattctttgtgaattcttctgtagcatgaacaattttggaatactttcttctgtatcctagtttgcattttattcaagattagattcttctggttttgctcttcctggctcttttcactcattttttccctctttctattactgattttcgttttctatttttgttccattctattagagcttctattttacttcttttcatctgtctcatatttaatatattttatactttctttttgtccagatacatttctgagtgaattccccttgacaccattcatactttatttcagggttttggtttttttgtttgtttgttttgttgttgttgtttttcctgcttgtctgagcttcaatttgagtgttttcaatccttcctgggtttatggaaatggattccgagtagttaacatttcattagaactcttttaaacagtcatcgggaaatttgagctctgctttctcttctgaaatcctgtaccaactcccagtccacccagcttgctctctgaactcagccctatttctcagaaaagaataagcattgtgcttcttttgccattgaatgtaaaagagcaattagtcagaaagatatgtttcttgatttttcccagtattgcttatttatctccttggtatgttttcccaaaaattgagtggtatttaggggacttcttgggattttattcaatttctatctttgctgagttattttctgctacactagactatgcagagttttggggttttttctgtcacttttcaattttacagcataagcttgtctcattttccttttctgctttctacttatttatttttttagttgcaaaaaataaaccagttttctatttagttaattaggctccgagaaaggcatttcctgtgattttgccccctttaactattatttcacagtcttcaatgtgtatcattattttattttatttctattactctaagctcccatttgttttgtgtaataaaatatttatattacaatcaaatacactgttataatactttgggactgtctatatggaggtaatcatatctaacgaggtaactattgggggctcagtgaggagcaatgcggagggcataccctgactatggacctcccaggtgcaatagttgaaagtaaaaatacatggaaagtttcgtgttttgtgttaaaactgcagctataccacctgcaaagctgaatgtgttcagatgtatcttttattacaatgctggacttcacacatcctgaggaggaaaagacagtggcttcatacgccagaagtcggatttccgggcttctggccacctatctgaatgggggagatcatgatcttctccagcccccaccccaactactagataaccatcactttctagctccactctaaacccatactcttaaagctaagtaaactatttgcactaaaattcaagtgagcttaatcatacatgagcaatcaatcaaatcactcctatatatttcaggtacaataccttcaaatccaaaaacaaagaaaagtaacttcaaccccctgaggaaaatcttttgttttatttattagagtgagtttaaacctggccacagaaaacacctacaaagagccattaatgttggaaaatgttagatctgaggtacagaatcaagatgcatgatttcctaagttatccaaaacttgtgaattcattcagcctccaccaaaattccaggatctggatacatctgaactttggaaaggatgtgaaggcccatccttctaagctttttacattagatatttttaaatttcatatacaactgtaatttatgctgggaatgatatgagtcgacggcagtggtatattggcaaatgtttaaaaaccagcccccttggatttaaagagaggaaaaccctaattgattgttaacttctgcagtggtataaatactctcaccgtagctaatttcaagttaccaatataatgtcactggatatggagatggaaatatatgtgctacagtcagttctcacaaggtgatgggaaccagttccagcacactactgtgtgcttaaaatataatattgcaagaacttcaagaatagtttaaacatacacaagattagccctatctggcccacacagccattcaattctttcctgtttcgaaggaagcaacgttgttggaagctaaagtaaagaaagagaaacacttttctgtccccacgtgagtttggaataatttcttctatccaaagcctgcaaatattttaagcccaaataatagcagttttgccctttagaatttattttttacaaagtacttcaggtactagtatgaacagcattaattatcaaaatgtaaactcttataacttttaacttctggaattacagttattaacgaggattatacaaataccttttataagttaaggcaaagcctacacacaattaaacacgagccaccatacgaataaataacagttaatactccaaggttatttcatactctgttcaatgacaactgcagctgtgccactatttaaagtgctgctgtgaaattaatataatgtattaggaaaaatgctatgtgcagctcttggagatgaagaaatctgagtgcgtggtagagaaaaaagaaagtaatagcagagaatagtctaaaagagaacatttagatattttgatttatttgtaaataatttgtataatcctctcaactggacatttttccaagttcaatatagactcccatcttcttttatatcctaatcaaaacttaactatcctatcttcagtgcctcagaattctaggctctccctttcaagtttgcaactgttaactgataaatgtgtcaaccttaaaggtatggtgtctaaccaaacaaacaaacaaacaaaaaaaactgacatctcctaggaataacagtgtgtttgtctttggagcattcctaaaaacacagtgccttcacccaacctttaaatagcatggcataactatttgcacagcacctgggatgagtagtcaaggcatctagtgactccagatgaccagctgggcttacatcactctaggctaggcccagccattgggaatgctgaaagaatgaacatctcaacacaacttaatctcatttattgcacaccagtgtcccacattacattggttggaagactgacttaacctaaaggaaaacaccctgttgcaagtttggttccctaggaaacaccctctgagatgaaagctagactgcagcacatttattgaggagtgtctttgggagcaacacttataggagggggagaaggaaacatcagtaagcagagcgggatgttgagctacgatgcaggcccactgacagcctcagccaaacccaagtggagctctggagctagaatggccccacaaaatggtactgagatgggcgaagatggccatgcctctattctcctacatcaatcagtcaacggatgtgagccacctcaggaaagagagtgaccttggacaagactgccctccacaactgtggcaatctttgaaggggctgaaaattgaagactgtttgccagcatccctcctagcagcgcagacaacacatcctttaatgaagggagatctggtcagtacattagtgtctactgcagatcaccaaactagatattctgaatattgatcggcctcaataccattcacttttgcaacataatcctgatcagagcatctctcagtacaatcaatggagaggctgaaagggaaacacatacttccacgactctgaaggcatagctgctacttatctatcgcagatttcatagctgcaacatatgaaatctatgaagatccattcccaagggaagagtccatgtaatcctataatcatctttttgatagcctacatggatgcatttggcatccattcttattcagcccaaccactgcccctcactttaagtatagatgtctagcttacctgccttactcaaagctggggccgactttcaccaatgcactatactttaaggagtaaagtgttatcacctaaaacagggacttaccatgaagggtttgctttttctttctggcttgactctgaaaataccaatattccctaagtggtactaaatttatagccggacatcatttaggctcagtggccttcacgtatccaattgtttcaccaggatgggagaacacagtcaaggcacaaaaagaagctactggataaaagaataactggatggagtggggaagtgggtacagaggagcagaatgagccaaagaaagacagttgtggaaaacttccactttccaaattttgcctccatttgcctcttcatgtattgttttcttagcaatctttggagaagtgccataggatattttcattcagctcttgatggaaaatacagactgtcttcactaattcttcaaataatgaacaaaacatcaacttaatatgaccccagaggaatgaaaacatagtttaaaaaataaaacacagttccatactaacataattgagtgttgaagaaagttaaattaatagaaaatgcaatggtaaagctatccacacatttgcatatgccattcccttcacctgaaacagtccccttgcttccacatgtctaaagcatgcctacccttcaattctaagtctaaatcctaattcatccatgaaggcttccccaaatattccaatcgtgtttcctacccaactgcacagtgctcaatgtctctgtaaaatatttgactttcatccttattttttgttgtatttctactgatcattcactatgtgccaagtacagtatttatcaacttcatattttttatcattgaatctttgcatgtacactattatccagttttgagtatgtccatttgatataaaagagagcagaaattcagggaggtgaattggcaccacaagcaaaatgggagaaggtgataaacccagttcagatatactacaatgtctgtgtgttctttctactgatgcctatactgtgcatgcttctcatttccctcaagtagaccatacacctcttgagaaaaggaattgtgtataatatcccttcctcgtacttttctattcctatcccacgtcatctcgaatgacaaaaagcatataatatcatacatatgtttgagaaaaacaaggaaaagaggctatcatataggggtatcaatgagtagattcctacaagtattccagaggattattcctgaggaactcaaaatttagcaaatggatacatagtttataaaaatattaagaacaatttggcaccagtctttctctgtttccatatggtggtgccaatttgtgacttagttaagacgttcactttctcacacagtaatgccgaaagcaagtgactgggaaaattgattaagagaggggtttatcaatggcatgaagaagcctaacacagatacatgtctggttgccttttattaaaataaatggaaattatttatcttcaaatgataacaatacaaatggaaacacttggcagttcccttgaatatataatgaaggattaccctcatacccacatttatatcctgcagtgtgcataacattgaggaaaggccaggaaagtgacaactccttaattagttagtgctcagtgacaaactggggaaacttgctctggaatctgtagagaaggaggagatggtagattgtctaaaagtctctctctcttctctattatatgtttcacaaagcgtgtgtttttatttcattgttaaagatgtacaaacccaacgaaatgagattcactaaataccatgctaaaaaccaaatgaagggttttgcttcatttagtacctgaatcaacactactttacctatcaaggcagacctgaaacctccttttaccaatttttcttctgatatgagaaaagcaattagaaccaactatcaaattttattcatcagtgccccgataagcaagctgtatgaaaaaaatattttaagtaattttcctaaaaatgttaccctgtaagcagtcacaccctccttctagagttatgactcatattatttattgaattacatcaaatgccgtactgaatttagtaatgatagctgtatataataattacatgctacattgcctccattggaaaccatggtaaccgatcagttactgtttcagccagccgccatagctgagaatagcacagaggaaaaatatacccatcatcacacacattcaatctgcagataacctgggagggagggctacatttggccatttcatccttttattgccccatttaggactctcctagaccatgccaggcttaattcttccccagagcctttgcatttactcttcttcctatctggattgctctccctctgtcctttacatagctgattccatcttgtcactcaggatttagctcaaatgtcatctcagagaagcctttcttgaccgcctgaccccaagaactaaactagttccctccaagtctctatcacctggagggcacttaccattttctgaaataatattggcatgtgtttatttacatgtatattacctgtacacataatgtgctgtgtgccatataacccctgggttattatctccttgagaacagtcaccttgtctttcttattctcaacaataatcttaatgtttatctccttctccaacaccatgcagtctttccccccaaaacaaataaaaggtaatactttgacagatacgtatactttgaagatatgtatatttcaatgacagatacacattagattctccacaaatatctgataaatgagaaaaaataaatggaaaagatgaatccaatcaatcaaacagcccctttctaagtggtatccctccaaatacttgaagaaaattatcctgccttatttgcaactcttctcagagatatacattcataatctcttcagttcttcttagacctgttttcaacatatctgaacacttctttatgtgtcttggacctctcagtttattaatatttcatcttaaaatctggcataaagaaccaagtcagagttttccgatgtgatataaccagtgcagatatggttactgacagacataatcaaaataacttcatcctgtgaggcctgctcaagccactagtcaaccagccaccctcctgaaatactaccttgtttctacagtggtaaactgaggcagatgtgggactaccctgtcgctatagtagtaatctgaggcaggtgtgatacaatgcagtgcttctcaaattttactatttagacacttccccttaagatccctgtcccttccttctcagatatatttcaacccttctgtaaaatgactggcaatgagatcaaacctttcttaaaatgaaaattctgattcagttggtttggagagaagcccaagattcaactatttctagtaagatgctggtctacaggcattattttgagtagcaaagctctactggaatgctgaaccaggaaaacagataatctagtttgaattgaagccttaccatttaataacagcatacaggtgaacaacttaattggttttcttatctataaagtagagataaatagaactatcttggagagagattttttaagagttaaataagataattaatgtgttggcacacagtaggaatgtaataaatattatctcaatgaatggccttctatcaatagaagttggcagttcatattgaacgtatagtcagaaaaaaactgacgtcttttcatagaaatggcttctaggcaaaatttcctctcatctagcatttgtacatttgatttttttttctgaacctaaatacaggatttaacatttataactattaaatttcatcttgttagctttggccagcattccagcctgtcaagattgttttgaattaagattcagctactcgatgtattagtcattgctccaagctttatgtcatctgcaaatttgataagtaagccttctatgtcattatacatatcattaaaatgttgagtaggacaagaccaatggctgagatattctacattttatttgttttgaaggaaagactattcatgggttagggggagaagctgagattgtttgacaaactaccaatctatttaactgaatattatccagtctacatttctccatttatccctctatagattccataaaatagtcctgtgacattggttaaatcaaaacacattatgcctatggaattttatctttccatctaaaactcaaaataaaaagtgaaacaagattagttttgcataaggtatcctcggtgaacctaagctatctcctagtaatcaccattttcttttctaagcattcaatcacaatttgttaacaacctattttgtaatttcaacaaacaagatttcatgttatagtcattagtagcatatgcattctgtgactagagactgttagacacattttccccaaattctcaagaatgttttatacatgtttaccatatgcaaacaccttttccttacccttgtaggtaattcatatagttctgaagatggaatcttttaaaacaggtaggcatgccttattccttacgtatctcagcatttacttccctcttgattatttttattctactctctctgttttcagtcccattttcctcaaaataaaagataaatctaacgtaataattgggtaattctaacgattgtttcttctgtaatctagctttcttttgagaataccctgtaaaaatccatactgatgggagttttccctttgcagccacaacagtttttgtatgtggctgcccctccagcaacatgttgtacatccccatctcttctcacttatatttcaactctgttttaaaaccattggtaatgaaataaaacctttcttttcttttttgtcaacatttttggaataaatagtgatctttatttaaagaaaagtttattctcctattttgacattataaaactacaccttccccactcacatttttgcacaattcatacacaatgaatcagttaaaacaagttggaatcttaatttatttgagatgccaattttccatcaaaataaaacaaactcagttgcctcctacacacatgtgtgcacatacataaagatacacacacaccctgactccatcaagtcccttggttctccactagtcttaccatgtcttcataggtccctttttaacagcctgcatgctaaacatgaattccttaggtgacactggccccttctgaaacccagtgatgagatgatgaaggaactggggtgaaccctacttgtaattgcttgtgagatggaggttccaaacacgatttttgctagcctcaagagagaaccaaggaacgtgacatagctggtagttgtgtatgtgtgtgtgtgtgtgtccatgtgtgagatggtactgttagttttgtttcgatggccaagtagggcaactcaaataaattaagatacctatttattttaactgatcaatttaatagaaacatgaatgtatatagatatgaacaggaaaggtatagtttcataatgtggactcggagagaaatggtagctagccaaaggtcacatacctttacagaccagaggtcttaagaagtttgggatgagcttagatgatacatagccagcagccatacagccatgagaagttccaatcactgtataggagtgttccacgaaatccctagttgctatttttacaggtgccctctacttgacacccataaagctaggagtggacactacttctccacatgtgcctcagaagaaccaaatgcatccaccaccttgcctttcgaaagagctgctgggccatgctatatggtgcttgcttctgccttcccaatatccagtgttaatatatccccttggcagacatgaagaacaccagctccaagggaatgtgggcaatgcagcatttaacatctctgtctttggggcactggaaagcacctagaagcagaaaagaatggtgttgagcttttctgcttggtgatacctggcagggaactactttctagattcccatccttttaaagaaattcaatgcacatcttctgcaaactcaagagattattcctgaatgcattccccaaggaaagatgttcaaaactagaaccatctcaaggtgtttgttctcttctaatattgttacagagcaatgaatgctcagggtatacgtcatcagtcttgtatttttcctacagcttgtttccacagcaattaagagcttgaggttatttggttgtgtttttcatgtttacaaaaatactggtggtgttgaaaggacagatgaataggctctctaagtgtggcagagaaagcaaagcagaactttcaattccacaaagcatctcacaaattctcctttattgccagcacaatctgcctctggctttaaaaacaataactgcatcttttcattcttctctcttaaaaaaacttgtccctgctctcaaagagacaaattttcattttttcctatgctttcaagaatttattaatctcagaagccaattattacaaggaagtggatatcacagaaagaaaacatgaactatagatttgggagataaatgagcagagggaaactcaagggtattttaaagttactactggtttcttcaccactgtgaaaaaccaaagactttcaattcctaaattcaggccttgaggtaacattagaacattgtgtatttatctgtacaactggacattgtatatttatcagccacttgtgtggctaactcctaaaattaccactgaaaagaagatttatgctttaggagtctcacttgcctctgtttgagccctaagatatcatggtcaacggcaccctcttaaaatctatttttaccagttataattgttaaggaataattttctagttataattgttatacagaaactgcacaaaattaacatatacaatttggtgattttgtacatatgtataaactcatgttaccttcacaatccaggttataaatatattcgtcacctccaaaagttttcttgtgtgcctttgtggttttgtgcttgggggaagtaagaacacttactatgaaatttaccctgctaacaaattttaggtacacaataccttattgttaactataggcactgtgttgtacagccaataaggccaaaattcttgtattttatatgcatctatccatatggccccagagttaatgggtgcctcctctactcgcttgccctttgaaaatgcacagagctagccatgccttgtagaggaattatttggccaacccacttcccattgcttggaaccaaccgtgaaataattagaacactgccatctctttctccattatgtttctagaaattagggcaaaataggaggctagaggaagcataaaataaaagctagacttcagaccagaggaaagctgagagaataactgttttgaggtatcctctgatcaatgccacttaatctgtcaccttctagtttgcgcatctgttcatgatccctattcttaatactcttgcttgatcctggatccttctcagaatacttagcctagctttagagaaaaagcttaagcaattaactacattgcaatgtgaaatgtggtcaatatctaaaagatgtacagttaaagcattatatataggaattcagaggagaggttactatatatgcttgaatacaaggcaagtcatttttctacaaatgacctctcccttatattgcattccgtatacatttttccagaatacatgttctatcagtaaatatactttgaacaacaaactactattccagaaaaatatattagcctaaaccagtgggtctcttacttcagtgtacatcagaatcaactggagggtttgttaaaacacagatagctgagcaccatcctaaaactttctgaggtctagggtggggctgaaacaggcatagttctaacaaatagccaagtaatgcttatgctgctggtctgaggacctcattttgaaaaccactgctctactaatattggttttagatcagtggttctaaactcttgttgcacattagaatcatctggggagatttcacaaactaacattccaaggctccgtcccagatcaattaaattagaatacgggagagaggacctcagtgtgccctgcttgtagtttttaatgcccttcaggtaattctaggctacggccagggttgaaagcacctgttttaaatcagtatcaaccaatttcagctaaaataatcagggttttttttttctatattacaagtcaccaagcaaaaaataataatcagttttttaaagaggaaaacacatttggcctaaactcagtaaataatcctggggcatgtggctttacatgtgcaaatgaggatacatggttaatttgtggaaatcactaatatatgcctaaagaatggaaaataagaaacaaaacactcttctaatcacacaggtacggatttttgcagcttgggttaaagcttctagtagcaacattataggaagtggtatatatcaaacaacataagtgaaagcaaagatggtatcttatgtaaaaccatgttggaggaccaaaaggagtgacctctaatgatcataaagacaatgatactgaaggtacaggtgccaagtttgaagaacattgttcaaaaaaagtgaaaacagaacaaagcactatttctaaaatcactgaggttttataaatgtgattttaaatatgcatgtgtaactctattgatacatttgatattgtcagtagactaatatagtaggaatatacattggtcaaatgtattgagtactagcaatacagatgtgaagccatcattgagaattatcttcaaaagtacattcgaaatatattcaaatatattcgaatatcttcgaaatacatgcgagtcagccaatatttttattctctgcatgcataaacttggataacatctcatacccagggatatacagaatttttggctaagagtatcaggaatgtctttctgggagaggtggtatttgagctggccttcataaaataagtaggtattcatcaagtaattcaaaagtagaaagttcttccaaacaggagaaaccacacgagtgatggaattgtgaaaagaaagcaaaaggtgagtagtaaagacgccaagatgaaaaagtaatacactgctaaatcgtggcgacttaacattaagataaggaaattttacttttattcagagtattttccagatgatgccccctccagtaacagatttctgattggaaacatccttattgctcctcaaccctcttcagccttcacttctcttcagaaaaaaacttgaaattttcgaaaatgactctaaatgatggcttaacacctgtattgctagtcctcatctgacttttaaaaactctatgtcatagactcccatgaacagttagagatcttgaagaaaaaaaagtcgtcacataaacgtagtattccagttacctattactgtgtaacatgcatccaaaaatttagtggcttctaaaatcaatttattatctttcatgattctgtttattaaccaggtgtttcttctgcctcacatggtgttggctaagatacagggatatctaaaaagttcagaatggctctactcacatggctggctaccggatggttactgagctcaactggaggctttagttctcctgcaggtgggactctccacatagctacttgggtttcttcacaatagggtagatgggttcgaagaatgaccattgaaaaaggtgaatgagtaagctacagatctcttaaggctcatcctttgatgttacgcagtatcacttgagatgcattccattccaaacaagtcagaggaatgggccagattcaacagggaaaaaaggcagactccaccttttcataaaggagtgacaagatcacattgcaaaagagtatgtgggatgggaaacatagttactgccatctttgaagacacaatgtaccatacacacagaagtctagccattaaccaatacgtggggacttcagggattagcagtaaatatgatgaaaatattgtacaaaattatataaattaaaacatttaaaaatcttcttaaagcataatgacaaatcaaaaattagcccagactgagaaggtaaagatctttactactcttcatcggaatggcataatagatatagataaaaccagctgcaatgttgtcagctaaacagtaggtgctggaccataataattccaaggaagcaaagtggatctgagttttaataaataaatatatatattaaatatttatatataattttctagaaaatatgatacatatacatatatataattttccaaaacacccttcatggtcatgtctttcttattcaacttaatgatggtagcagtggtgatagcagcaggaggataacagtagaatccatttttttaaatcataacatttttatggggatttccagtttccaattctgcatgtaaggaatttggaagtcatcactttgtcctaacgatagaaagctgaacaaactgaaaaatcaataattcttcttagatccataagagaagtgtggtcacaaggcaaactgctgcccccaaaattgaagagacagataggtggatacagagaatcacaacatagcagagcagaaacctctttgggaaccaaagctgatgcaggaaaatctggactgaaattgacaaattgccgtaggcagggcatggacaccttggagttaaaagctccaaggtgggcagggcatgatggctgacgcctgtaatcccagcgctttgggaagctgagacaggaggatcacaaggtcaggagttcgagactggcatggccaacatggtgaaacatcatctctaataaaaatacaaaaattagccgggtgtggtggcacgcgcctgtagtctcagctactcgggaggctgaggcaggagaatcacctgaacccaggaggcggaggttgcagtgagccaagaccgtgccattgccctccagcctgggtgacagagcaagactccatctcaaaacaaaacaaacaaaacaaaacctccaaggggacccagtaaagggaagcaggggttttatcagtacctaactgacctgggagaagggaaatactcaactccggtccactctagccaacctgcccaggctaagaggagaaaacaaaactgagaaacatttgtgaagttcacagtccagaggcataggctcattaaaagactgagatataatcaaaggattatagaatgcttcctcaacacacactttaccaccacattactaaagtcctatttacagcagttccttttacctatttctcaatatctggctatcaataaaaaaaaaaaggcatactaaaaggcaaaaaacataacaaaacaaaacaaaaacacagtttgaagaaacagagcaaacatcagaaccagatatagtagggatataggaattatcaaacaaggaatttaaaacattaatcataaaatcaaatatgctagaggctctattggttaaagtagacagcatgcaaaaacagatgggcagtgtaagcatagagaaatacaaatcctaagaaagaaccaaaaagaaatgctaaaatcagcaacactgtaacagaaatgaagaatgcttttgatgggcttattagtagactgaaaacagctgtgcaaagaatcgccaagcttgagaatataccaatagaaatttttaaaagtgaaaagcaaagataacaaagactaaacataaaaacaaaataaaaaaataaaaagaatttaagaaaaagataagactgaattaaaaaatcagaacacaatattcaagaactgtgggacaactataaaaggtgtaacatacatatattgggaatactagaaaaagaagacaaagaaaggaacagaaaaaagtatttgaaaaaataatgactgagaatttttccaaattaatatcagaacctaaccacacatacatgaagttcagaaaaccccaagcagaataaatgtaaaaaaaaaaaaaaaaaaaaaaaaaaaactacacctaggcatatcattttcaaactacaggaagtcaaagactttttttaaaaaaattcctggctgggtgcggtggctcacgcttgtaatcccagcactttgggaggccgaggcaggcggatcacaaggtcagcacatcgagaccatcctgactaacacggtgaaaccccgtctctactaaaaatacaaaaattagcggggcgtggtggcaggtacctgtagtcccagctactggggaggctgaggcaggagaatggtgacaacccgggaggtggagcctgcagtgagctgagatggtgccactgcactccagcctgggctacagggctacagagcgagactccgtctcaaaaaaaaaaaaaaaaaaaaaaaaaaaaaaaaaaaaaatcctaagagaagccagagaggaaaaataatttacataaagagaaacaaagataagaaatacatctgacttctcttcagaaaccatgcaaacaagaagacagtagaatgaaatacttagtattgagagaaaaaaggcccaccaacctaaaattctatagtctacaaaattatccttcgaaaaaaaggcagaaatcaagtttttcttaaacaaacaaaaactgaagtaatttgttacctatagacctgctttgcaagaaatattaagttattcagagagaaggaaagcaatacaggtcagaaactcatatctacctaaagaaagggcattgaaaaaagaatgaatgccagtaaaataaaaactgttactttttttattcttaattgatctaacatctaacagatcaaaatcatactagcaataatgtatttcattatacatacttgtatgtgtatgtattcatatatatgtgtgtgtatatatatatatatatagtgtgtggggtatgtgtgtctgggcttatataaaggcatagctcattttattgcattccattttattacaaattgcattccatttgtaaaaaaaattgcatctttttataaattgaaggtctgtggtaaccctgtattaagtaagtccatcagggccattttttcaacagcatgtgctcactttctgtctttgagtcacgttttggtaattctcatagtatttcaagatttgtcattattattatatctgctatgatgatctgtcatcagcgaccttttatgttactactgtaattgttttggggtgccatgaaccatgcccatataagatggcaaacaatagataaatgttgtgtatgttctgactgcttcaccaacggccattcacccatctctttctctttccttggacctccctattccctaagaaacaaaaatattgaaattaggacaactaataaccctacaatggcctcttaagtgttcaagtgaaaggaagagtcatatgtctctcgctttaaattcaaagctagaaatgattacacttagtgaggaaggcatgtcaaaagccaagagaagccaaaagataggactcttgtgccaaacattggccaagttgtgaacgcaaaggaaaagttcttgaatgacattaaaagtgctactccaatgaacatgtgaatgataagaaagcaaaacagcctttttgctgatatggagaaagtttgagtggtctggatagaagatcaaactagccataacattcccttaagcaaaggcctagtccatgagaagggcccaactctcttcaattctatgaaggctgagagaagtgaggaagctgagaagaaaagtgtgaagctagcagaggttggttcatgaggtttaagaaaagaggccaggcgcagtggctcacacctgtaatcccagtactttgggaggccgagatgggtggatcacctgaggtcaggagttcgagaccagcctggccaacatggcgaaaccccgtctctactaaaaatacaaaaattagccggatgtggtggcatgcgcctgtgctcccagctactcaggaggctgaggcagtagcagcgcttgaacccaggaggcagaggttgcagtgagccaagatcgcaccactgcactccagcctgggtgacagagcgagactctgtctcaaaaaaagaaaagaagagaagagaagagaaaaaaaagaaatgaaaaaagaagccatctctataatacaaaagtacaaggtaaagcagcaagttctggtataaaagctgcggcaagttatcaggaggatctagctaaaatcactgatgaaagtggctacattaaacaacagattttcaatttagatgaaacagccttatagcagaagaagatgttatctagaactttcatagctagaggtgagaagtcaatatgcatatgaaaagatgctttctttaatcagttttgtagctttcctcatacagattttgtccatgtttcattagatttatacctaagtatttcattttggggggtgctacagcaaataacactgtgtttttaaatttcaaatcttacatgtccattgttggtatataggagagcaattaatttttggatattaactttatatcctgcaaccttgctataatagcttattagttccaggaggattttgtcaattctttcagattttcaacattgacaaatatgtcatctacaaataagaacagttttatttctttcttttcaaactgtgtatctcttatttccttttcttatctttttgctagctaagacttccagtatgatactgaaaatatgctccacatcacgtgtcattagggaaaggcaaattaaaacaacaatgtgataccactatacatctattacgacggccataacccagaacagtgaaaatagtaaatgctcgcaatgatgtggagcacaggaattctcattctttgctggtagaaatgtaacatggcacagccactttggaagacagtttggtgatttcttccaaaactaaacatactttactatacaatccagcaatcacctccttgttatttacccaaaggaattgaaaacctatatctatacagaaatttgtacacagacgtttagagcggctttattaattgccaaaacttggaagctgccaagacatcctttagtatgtgaatgaataaactgtgatacattaagacaatggaatattattcatatgctaaaaagaaatgagctatcaagctatggaaagacactgaggaaacttaagttcatattactaagcgaaagaagccaatattgaaaggctacagactatattattccaactatatcacattctagaaaaggcaaaattatggaggcagtaaaaagatcagtgggtttccaggtgttaggggaaggggaggtatgaataggtagagtacagaggaattctagggcagtgaaaataccctatatgatagtataacggtggatacatgccattcatacatttgttcaaatgcatagaatgcacaacgcccatgtaaactatggactctcagtaataatgatgtctcagtgaagttcatcagttgtaaccagtgtaccactctggtagtggatgtttataaccggggagactatgcatttatagggtacaaagtttacgggatatctctgtatcttcccttccattttgttgtgaacctaaaactgctctcaaaattgtctttaaaaaaatcttaactaccatttactgaattattcctctatactaaggactggaagccatcatttaattctcactcaacatttaattctcacaaccaccctatgagaaaagtaccaccacctcaattttatagaaaagagaagcctaaagaggttatacacttttcctaaagtacacagctagcaacccatgaagatggggttctaactcaggagttgacaggtttgttgttattgttttctataaaggaccagagagtaaacaatattggctttgtgggtcacttggtctctgtctcaactacacaagtactctactctgccactatagcatgaaagtggccaaagacaacatgtaaactaatgagcatgattgtgtttcaacaaaactttatttataaaaataagcagtgggtaagatttggcctgcaagccataattttctgactcctattcttgctcaagactgatctaagcttcttgactcagatttcatgaaaaaatgttttttatatctttacatccccatcaacatctagcacaccaagcacgtatgcataggcactcaataaatatttgttgatggaatgaccaataaataaattaattcaactaacacttattgggcatcaactatgtcctaggcactgttgtaatcacttgtcctaggcactgttataatcacttgatatatgttactgaacaaaacagaaatccctgcctgtgaggagcttacaatttacaaatctccaactcatatagcataattatacgggtttcatattgctgccataacaaattcccacaaacatggtggcttaaaacaacacaattctgttatcttactgttctgtaggcaagaagtccaacatcagtctcaccaggcgaaaatgaaggcattagcagggctgcattcctttttggaggatctagcggaagatttctttcctcactcattatggttcttggcagaattcattctctaaacactcccagtatctcagatactcccagtgtctcagaactagcaactgggtgttgaatcattctcctgcttccatctttctttctgactacaaccgggaaatgttctccaattttgaggacccatgtgattgggtccttaaattgggccgacttggataatacagtataatctccccatctcgagataacgttagtcacatttgcaaagtctgtttcgtcacgtaaggtaacatattgacaagcgccagagagtagaacatgggcatcttttgggggacattattctgtctaccacaaatgccatcatagaattttatattaaatctgatgaatttgatctttgccaatggatcataattctagtgagtcaatatgacataaataataaattatttaattataaataaaattataaattaatgtgtgtgataatccattaatctcagaataaattacacttttcccagctttgctcaaacctgtagatctgagaattgctactgctcaagccagtcctaaataatgccagcagttttcaaagactcttacctaaaattaaaaacattaaaaataagtctttttatcataagcctggcatatcttgaaggaattctccattttgaacacaaactgtgcattcttagctcctgcctaaaaataggattcctacatgtcattgaattgaagtgctgcccctgcccttgccatgttagctcaggccacttgactgggcctctgcctttgttttatgatttgcctttcagtcccctaacattgactagaattttagctgcaaagctgtcatcttccctaacccttaccaatccccccaactgcatttatattacaggcagtggtcacgtcttcctccaactgagatggacaatatcaatcataatgcaagacttttagctccaggagagttactctctggtttgcccaaccttttattgatgatagacactatctaaactggcccagtttcccctaagccacagcattgaggcttggtctgctcatcactctagcttctcaacaccaggcctgcccttaaagctagcctagttcccaaaatccaaccctaggtgtattatttgtcttccttaatggccccaccatctacccacggttaaattaaaaaccctggaggaattttcaattccactctgcctttatcaccaactttaaatcaccatattgttctgatcaccatggaacaaacagagaaggactggcttggcaagggaaataacagtttctgttttagagaaaaggcccacttttcacccctagacattcagcaaccctcgccaatgaagcaccctcaggtcacgggagaaggttctttataatctctggaatgaagggagacttttgaaagttctggttctggttcgagtagaaagaatattaatcttagagttttaaagacctgatttcttttttaggctctgccgcctactttgaccattttttcaactaggaaatgcaaataacacctaccttacggggtggctgtgaaaattaaataaggtaatgagtatgaaagcactatgtaaaaggcacgtatcagctgttatcattatgattatcctactaataccccctgtctccactgcagcaaatattactactgttcagggtgatgggtgaatattataaagctaatcattcagatgcattcaaaagaccattcacttttgttttatcgtattagcagaggttattttattctaatcctgtccatcaagttacattttggacagagctcagtctgatcgaacctgccaatatcagcttgggtctacttaaagattcattcaaccaccttctctgaaagcacaagccaacatttgtgtatatctgtatcataaatcacatgctaacaagtgccaaaagcagtcacctcttttatgaatcagtcattgattcccaagactgaattagccccttcttctcctatttaccatcatatgttgccaactctgtgatagcatttataatatggcattataatggtgtctttgaccttctacaagagatggtgagcaactgtagggtagagatttagtctttgtattctcattcatggcacacagtagatagccaatacatgtttattaaaataaaggagggagagccgggtgcggtggctcatgcctgtaatcccagcactttgggaggccgaggcgggtggatcacctgaggccaggatttcaagaccagcctgaccaacatgaagaaacccggtctctattaaaaatacaaaaaattagccgagcatggtggcacatgcctgtaatcccagctactcaggaggcagaggcaggagaatcgcttgaaccccggagtcagaggttgcagtgagccgagatcgtgccattgcactccagcctgggcaacaagaatgaaactctgtctcaaaaaaagaaagaaagaaagaaagaaaaataaaggagggagtagaaggagatccacactataggggaaattaccacttaaatagctacattgctctagcatattttaggtatgcagggatttcaaagaaaggagaaacaaaataaagaaaaaccattctttccaaaaatctccagtttacttttctatagcatgtttaaaaggtgttatcagttgtttgtaagtgcaatataaattaggctaattattccaaacacttcacattagagatacgtgaaagaagcagcagtttatttgaacctctcagctcttgaatgacctgtgccttctggagaaggagagagcttaagttttatttagagaaaaatccagcattacatatagaatatagatgtgtttctgagaaggaagaccagagagggaggaaaatttctcatttggaaagttgttcctataagaattttaattacatactttcaaataataacatcacctatcttgatatcatataatcccttcttggtaatcttccttgatatttaagtctaaaattagcccaagtaacccttggattatatgcaaatgaaaattctgtgctattgcagatactttttaaggcactgctaccattggaaaacatgattctcctgggttaggtaagaggtcagggcttcaatgactaccctactgcgcttcagtcatgcatcacaaatgttgacatgtacccctgagagtcttgcggaaatgcagattctgattcagtgggtatgattcagtggatccaggtcatgtacaaaggatcggaaatgagactatttctgaccttttaacatttccaacaatttcccaggtgatacccaagctgctgatctgcaaaccacacattgagtaacaaagttatcatagacatggtgatttttaaaaattcactatcagtgaaattttttaaggtaatctgccactgcacttcccctatgtcagtggttatgaaaattttccacttaacaccttttacttgagagaataacagctttaataagcagccttgaaacactgaagcttttagttagtccgaatttaaccactatgcaaaatgtggcttatgtgatgattaagaaatgataacatccttggcagatgaggtaagttatatttaagctacattttttcttcaaaaagtcctttttctatggctcaacatgggaataaaagggattctcatctcacgtgaccatttcccagtaatgagatagctcttggaataatttaactgaccaggagagccaatccagagagcccttaatcagtaatgacaaattgaagcaccttaaaagtaaaagaagttgtgttttccaacgcttgccattttagattttagccatgccctagagttataaaactgcttcctcatcaatccattctccatgccactaacattacttattttggctgagcattcaagagtagaaattttaaactaaatgatagaagaactacagctcctagacagcatacattacgccatggcagtattgaaaatctgcaggccctcacactcagattgaaagttttccctctcattttccccttctcactaatcctctttttttctcagtttcctccctaccttaagcagttgatatgctgtataaaacttgtggatgaagtaaatcttatgagaaaaagtatattttaagtgcacttaacaaaaattactttttgtgatgaattctatataaagaaataaattattctttgtaaacaaacattccccaaatatctgttaacaaatttttcaagctcttgtctcatcattttaaagcagaatatctctacactttcacttaacacatcactttaaatactttcgttttgtttacttcaacaaagggaaactaacagccatgagattggtgaaggatctggggctatcaagagcagtagatggctactagtagtagggcagaaaaataatggagagatccattatctagaacccaggaagatctgtggttataggaaaaagacaccctgtgcccttggatacaggaatacagccacttcccttccactggtcaaactgaaccctaaattgacaatgtcaatagaggtcagactcctaaagcacagagcaggacagcagggtagaaaagcatggagatagaacttgtaaggctgtaaaaagagcactgggcacagtggcaggtatacgtaacatataggaaataggagagttgagggaacattcacttactgaatgctgagaccattaatcccttccccacagtcacagtagccaggcttcaatactcgaggcaggagattggatggttcatctctaggggatgaaaaagaaatgaaaaactagattaaatattggaagacaaaattgagaaaaaaataatgtaaagcaaaaagacaaagaaatgaaaaattagaggataagaaaagtgagaaggaagccaacagttccaacataaataaacagttatagagtcccagaacatgaagggtgataatgaaggagaagaaatcatcaaaaaataaaattcagcaaaactttccagatggatttccagattggaaagacttgccaactatgcagcacaatagatgaaatcaggccctcaccaagggaactttaccatagaatttaagagcacggagacaaaatgaagataccgtgagcttccagagagggagaaaaaacaggtcatatacaaaggatcagaaatgagactatttttgactttttaacagcaaagtaagaagcctgtaggcaatggagcaataccaccaaacttttgaaggaacacaatacccaacctataattctacacttagccaagttaccaattagaagactttttcagatatgcaaaaactcaaaattttatctcctagcatctctttctcatttggttactgaaaaatgtgttatatcaaaatgaagggtgtaaaccagaatagaggaggaagtcgaatacagaaaacataaaactcagagacaaagatatcccagaatgacccatatgcaccatgcagagaaaataaccagtccaattcagagagatttcttcagaaaaaaataaaatacctgatgcattagggagaatttagataattaattagggagagaagttgagttagtgataagttgagttagtgataattatactttatgttatagggtaactataacataaggcaattattagtatcagaaaaaaatattttgcaaaaaacagcggccgggcatggtggctcacgcctgtaatcccaggtttgagctctttaaataatatcatatttcttagaagttttgttcatttaaaaaattctcactgggcgtggtggctcacgcctgtaatcccagcactttgggaggttgaggcgggtggatcacgaggtcaggagatcgagaccatcctggctaacacggtgaaaccccagctctactaaacatacaaaaaaaattagccaggcgtggtggcgggcgcctgtagtcccagctactcgggaggctgaggcaggagaacggcgtgaacccgcgaggcggagcttgcagtgagccgagatcgcgccactgcactccagcctgggcgatagagcaagactccgtctcaaaaaaacaaaaaaacaacaaaaacaaagaatcacaatatatgatgcagctcagttgtagtgtttacacagttacactaatgtaaatattgaagattgaagatttcattaacttacaagaggaagtctgaatatgtgaggatagaggaaaaaagagaacggaattgtcatttttctttctggaatgtcaatcaataatatttatacccagaaaatcaagaagtagaaataaaagcatgttatttagggaaatagagataaatactcaaagatatagctaaatgatcattgtagttttctgtataatttgtacagaaataataagcggacatatttttctgcattcaaaatttaatgaaaattttaaattaaatttaaaatatgaagataaatttcaaaattttaaagataaataatataggatatttctttcacttctgaggtatgatagttcacaaattacagcatgcaattcttgtctttctttacatgattgtttttaatatattcagttgcaaagggatatgtttgctttctaattatttcataaagcatgattaaaccaaatgttagcgttgaagtaaatgactcatcttattcttttgtccactaaaacatgaataaagaacctagatgcatctttgaaaatttctacaatttctaacattgattaatctttgtaccatatttagattattatgacttgaaattcttcttgaaagttggcattaccgttaatgaaatactggaagttttaaataatggaaactccttgctatataatagatgaaaattgtaagtcttttttcctaagactgactttctttgtcaagactttgatgaacagtttctaataatgacattttcccaggacaatttgaaaattatactttagaattcttaattaagttctgttgcttcaacatgccaacactatagcacatcaacaatgtgaattttctcctccactttgcataatgcctcttaaaatctatgataggaaaaatttatcttactcatttcatcaatctcctaactagaaaaaaaaataaagaggatatggcttcatagtgtgcttagagagcggacagaaactgagaagtatgctaagaaaatacaaagatttacttaaaattcgtttgcatagtaatgtgaaaatatatgtccatgactatttaagtcatgaaaaaatgaataggagaattgaagtgaaaaaacataattatcaattccaaatcaaaacatgaaaaaataatatcaagctctttaattcacattttatatgtattagtttatataatcctaaaaacaagcctataaaatgaacactattactatagtaacctattttacaaataatgaaaccgagacatgaaagtgaagaaatttaccttgctagaaagttgtaaatacggaaagtaaaagtaaacccaaacatctttgagcagaaactatcctttaagtcactattctaaaacaatttatatttaacttttagctaattacggttttccaacagattctatttgcgtagtaaaaatataagaacagtttatctttctcctcattcattttcaacttcaatgctgttatgcattttctccagtgttcgtgatccagtcctaatctagctttaagaaaaaaaaaagcaatcaactggagccaagatggccaactagatgcaaccaggaaaagctttgaccaacaagagagaccagaccatcaagtagaccaggatattctgaacagatttttagaaagaaggcattttagaaagaagacatacaacaaatgcaaaccctggatgataggtgaggaggctgggaaccctgtagggggttgccaagcaccaggacttgttcctggccctgagaagctcctaggaaaagggtgagtgaaatgggtgtggagtgacccactttcaccatggacctccatgatcctagctatgggagaccccacaattcccaggcacatttgagctggcagtgagaactgcctagcaagttggcagagacagaactccagcctgtgtggagcccagagggtttggcatgagactggctgcagtggagcatgaccatgggcatccatcccccaagactcgccatactcctctaggtgactttaggctttgttattaatagctgccagacctgggcagagcaaggctgtcttgcccttgagaaagaaacagcctgatctgaaaaccccctgtcttctggcctctcccaggattcctgcctggctgaagccacttgcagcacaaccactgccatagctctttcaccagcataccccacctaatcattggagtgcttctgcaaatggacatccaccagcagacaccaatccacagccttccccaaccagtgtgcaatcacctgcaacctccccccgctgccctgccagcacacacgtgtgtgcagacctgccaccaccttgccagcacagatgtgcacgggagcccaccactgcaccaccggagtgcttttcccagaagccccatcagagtgttgttgctagcagacttggaacactctaacctctccagcatatcaggtgcttaacctcaaaaggccagagaataaagctgtgggtttggtaccagcctcccgagtttatagcatgtagcccagcagtgctgagttgagtcttggcctcctgaaaccatccagaaatgaagccaattgactaagcccaacttacactgcaatcaaaccctcaaggacctcaaggaatacaaaagcaaaaaggctcatccaaaagacagcaacatccaagattaaaggaacatcagcccacacagatgaacaaaacttccaagaaatatggtattatttaaagagatcaaacctacaagtcactggcattcctaaaagagatggagagatagaaagacatttggaaaacttatttgaggatattgtccacaaaaattttcctaaccttgctagagaagtcaacatgcaaattcagaaaattgagaacccttgcaagatactgtacaagatgaccatccccagacacatagtcagcagattctcaaaagtcaacatgaaggaaaaaaatcttaaaagcagccagagagaacggacaggtcacataaaaagagaatgtcattaacagttgacctttcagcagaaaccttataatccagaagggattgggggcctatattcagcatccttaacctttttaccatttagaaaaaaaaaaaaaaaaaaaaaaaagtgcagctcactgccaatgctcatttaattttatataaacacactctttgaggctgaagaaaatctgactgattttcaatgtgaaaataaaatataaaaactgttcttggagttatttctaaatagaactaagaccagaattgtttgaatctttagaatcatctatttcaggaaaatcagattcatcaaattaatctatggccaataactatttgagaacaatgttaacatcatacataggattcctacattttctaaaatgtgacattctcagtgatcaagaattactatactttgtaaatggaaataccactactataaacagaatgctataaatataataatgtcttttgtttctaagttgatatactggagcaatgcaaaaataataataaaaatgagatattttgtggtaaatttatctcagagtaaatgctgcagctgccagcaagtattcctggggtatatgggaaaagggttaaagacaagaaattccaaccaagaattttatatccagccaaactaagcttcataagtgaaggagaaataaaaatccttttcacacaagcaaatgctaagggaatttgtttccaccagacctgtcttacaagaggttcttaagatagtgctaaacatggaaatgaaagactggtacctgccaccataaaaacacacttaagtacatagctcactgacattataaagcaactatacaatcaactctacataacagacagctaacaacatgatgacaggatcaaatactcacatatcaatattaaccttgaatgtaaatgggccaaacacccccacttaaaagatacagagtggcaagtaggataaaaaagcaagactcaactataggttttattagtcagagttcttcagagggacagaaccaataggatatatgtatatataaaagggagtttattaaggagaattggctcacatgattacaaggcaaagtcctgcgataggggaaaagaaagaagccatcagtggctaattcgggttcgaaagcctaaaaaccagggaagccaacagtgtagccttcggcctatgcccaaaagcccaaaagtacctgggaagctgctggtacaactcccagagtctaaaggctgaagaacttacattctgatgtccaagggcaggaggaggaagaatggaatcaagcatccagcatgggaagaggaaagagagccagaagactcagtaagtaaacttatcccaccttcttctacctgctttgttcaagctgccctggcagctgaatggacggtgcccacccacagtgagggtgggttttcctctcctagtccactgaatcaaatgtcagtctcctctagctataccgtcacaaacacatgcggaaacaatactttacaagccatctaggcatccttcaatccaatcaagttgacacctaatattaaccatcacaattgtcttcaagagatccacgtcacatccaatgacacccataggctcaaagtaaagggatggagaaagatctatcaacgaaatggaaaacaaaaaagatcaggggttgctattcttatttcagacaaaacacactttaaaccaacaacaatcaaaaatgacaaaaaaaggcattacatgacgataaagggttcaattcaacaagaagacttaactatcctaaagatatatgcacccaacactggagcatccagattcataaaacaagttcttagagacccacaaagagacttagatgacaacacaataatagtggaacactacaatatcccgctgacagtgttagacagattatccaggcagaaaactaacaaagatattcgggacctagactcaatatttgaccaaactgacctaacagacatctacagaacactccacccaacaacaacagaatatacattcttctcatctgcacatggcacagactctatgattgaccatatgctcagccataaagcaattctcaacaatttcaaaacactgaaatcacatcaaccatactactggaccacagcacaattaaaatagaactcaattccaagaagaactctcaaaatcacataattacatgaaaattaagcaaaattcagcatccttaaccttttcccatttagaaaaaaaagtgcagctcgctgtcaatgctcatttaattttatataaacacactctttgaggctgaagagcctgattttcaatgtgaaaataaaatataataaatgatttttggggccaggtgcggtggctcacgcctgtaatcccagcactttgggaggccgaggtgggcggatcacaaggtcaggagatcgagaccatcctggctaacatggtgaaacactgtctctactaaaaatacaaaaaattagccagatgtggtggcgggcgcctgtagtcccagctactcaggaggctgaggcaggagaatggcgtgaacccaggaggcagagcttgcagtaagccgagatagcaccactgcattccagcctgggtgacagagtgagactctgtctcaagaaaaataaaaataaaaataaataaatgacttttagataaagaatgaaatcaaagcagaaatttttaaaaattcattgaacctactgaaaacaaagacacaatgttccagaatctctgggacacagcaaaaccagtattaagaggaaagtttatgatgttaaatgcctacattaaaaattcagaaagattttaaattaacaacctagcatcacacctaggggaacaagaaaaacaagtgcaaaccaacctcaaagttaacagaaggaaagaaataaccaaaatcagagctgaactgaaagaaattgagacaagaaaatccatgcaaaagatcaactaaaccaaaagttggttagttgaaagaatagataagattgacagaccaatacctagattaataaagaagaaaagagagaagagccaaaaaatccaatcagaaatgaaaaaaaaggacattatcactgatcccacagaaatacaaaaaaaaccctcagagactattatgaatacctctatgcacacaaactagaaaacctggaagtagataaattcataaaaacacacaacctccaaagatagaaccagcaggaaatttaaaccctgaacagaccaataatgagttccataattgaatcagtaataaaaaacctaccaaccaaaaaaagccctccatgatatatatttacagctgaattctaccacatgtacaaagaggacctggtactaatcctattgaaactattccaaaaaacagaggaagaaggactccttcctaactcattctatgaggacagcatcattctgataccaaaacctggaagatacacaacaaaaaaagaaaacatcaggtcaacatccttgatgagcacagatgcgaaaatcctcaacaaaatactggcaaaaccaacctagcagcacatcagaaaactaattcaccacgatcaaataggctttattccagggaggcaaggttggctcaacacataaaaatcaataaatgtgagccatcacataaatagaaaaacaacaacaacaaaaaaaacccacatgctcatctcaatagatgcaggaaagacttcaataaaattcaacatcccttcatgttaaaaaccctcaacaaactaggcatcaatggaacatactgcaaaataatgagccacctatgacaaactcacagccaacatcacaatgaatgggcaaaagctggaagcattcccccgagaaccataacaagacaaggaggtccactctcaccactcctattcaagatagtactggaagaactagccacagcaatcaggaaatagaaggaaaactcatcaaaataagagagaggaagtcaatctatcgctgtttgcagatgatatgattccatacctagaaaacccctttttctctgcccaaaggctcctagaactgataaacaactgcagtaaagtttcaacataaaaatcaatttacaaaaatcagtaacatttctatttatttatttatttatttatttattcatagagataaggactcacaatgttgtccaggctggtctcgaactcctgagctcaagtgatcctcccactttggcctcccaaagtgctgggattacaggcgtgaaccaccatgcccggccccagtagcatttctacatagcaataacatccaagctgagagccaaatcaagaatgcaatcccattcacaaaagccacaaaagaattagaagtacatttaaccagagaggtgaaagatctctactacaatgagaattacaaaatactgctgaaagaaatcatagatgacacaaacaaatggaaacacattccatgctcaaggattggaaaaatcgattttgttacaatggacatactgcccaaagcaatttacagattcaatgctattcttttcaaactaccaacatcatttttcacagaattagaaataacttttctaaaattcatatggaaccataaaagagcctgaatagccaaatcaatcctatgcaaaaagaacaaagctggaggcttcacattacctgacttcaaactgtaaggctacaataaccaaaacggcatgataattgtacaacaatagacacatagaccaatggaacaggttagagaacccagaaataaagcttcacacctacaactatctgacctttgacaaagtcaacaaaaacaatggggaaaggacttcctattcaataaaaggtgctgggataactggctacctgtatgcaaaagattgaaactgggcctttcaccacatacaaaaatcaactcaagatggattaaagagttaaatgtaagacctcagactaaaaatctctagaagaaaatctaggaaataccattctggacatacaccctggcaaagatttcatgacaaagtctccaaaaacaattgcaacaaaaacaaaaattgacgagtgggacctaattaaagagcttctgcacagcaaaagaaactatcaatggagtaaacagacaatctacagaatgagagaaaatatttgcaaactatgcatctgacaaaggtctaatatccagcatctataaaaactcaaaccaattaacaaccaaaaaaccaacaaccccattaaaaaatgggcaagggacatgaacggatacttctcaaatgaagacatatacatgtctaacaagcatatgaaaaaatgctcaacatcactaatcattagagaaatacaaatgaaaaccacaatgagataccatctcacaccaggcagaacgactatcactaaaaagttaaaaaacagtaacagatgctggcaaggttgcagagaaatgtgaatgcttatatactgctggtgggaatgtaaattagttcagccactgtggaaagcagtttggtaatttctgaaagaattttaaaaagaactaccattcaacttagtaatcccattactgggcatagacccaaaggaatataaatcattttaccaaaaagacacatgcattcctatgttcatcatggcactattcacaatagcaaagacatggaatccacctagatgcccataaacagtcagctggataaggaaaatgtggtacatatacaccatggaatactacacaaccagaaaaagaacgaaataataacctttgcagcaacatacatgcagctggaggccatcatcctaattaacacaggaagagaaaaccaaataatgcatattcttacttataagtaggagctaaaaactgaatacacatggatacaaagatgaaaacaatagacactactggggcccacttgagggtaaacagtgggaggagggtgaaggttgaaaaactacctattgggtactatgctcactacctggtgataaaattatttgtaaaccaaaccctagtgatgtgtaatttacccatgtaacaaacctgcatttgtatcttctgaacctaaaacaaaagttgaaaaaaaaaaagtagccaggctcggtgactcatgcctgtaatcccaacactttgggagactgagtcgggcagattgcctgaggtcaggagttcgagaccagcctggccaacatggtgaaaccccgtctctactaaaaatacaaaaatgagcctggcgtggtggcaggtgcctgtaatcccagctactcgagaggctgaggcaggagaatcccttgaacctgggaggcagaggttgcagtgaccccagatcgtgccactgcactacagcatgggaggcagagcaagactctgtctcaaaaaaaaagaaaaaaaagaaaaagaaaaagaaaaaataagaaaagaaaaaggaaatagaaaaaaataccaaatctgaaaatactgtcaattataagtcctaccaaaatagtaatttctggtttccactaaatatacttcctttgtttgactcatcacttggaattgtggatgttttgacttatttggggcataaagtgattccctggcctttttaaccacacagtatgcacaaccttcccttgctattctctatcttcttcttaaggtttatttttctccataatacctatcataatctgacattacattatatactatatccatttgtttatatccttttgcttccaatataaattccttgaggacaaggagtttgtcttgttttccattataaacctcatagccagaactgtgcctacatataatacatactcaattaatacttgttgaatgaataaattaacaaattgtttttcacttgtaaagagatatcatcatgtatactaaggagatacactaaacatcgtagcattacattacatataatgcatcataaattgcatatagttaaattcctagtgatctttaatttgatatctattcaaaagtctttataattggcctttaaaagtattactactttgagtctacttataattttgtctcatttcaatgtaataatgtccttaagaaatatatttcggcagccgggggagtccgagaggaagcggaggcgcgagctggaggcggcggctcccgtcggcctccggcaggactgagcgctgggaagccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagccctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaaaggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctgtgaaaatatcatggaataatagggattttagggtggatactttattttcttttatatttctatatgttgccttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttagttgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggtggactgataatatttaaaaaataattgtgtttgaccccaaatgactttatacccaattctacataaaaatatacaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaggtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaacgttgcagttttttaaaataatgaaaataaatactcttggttttgctttgtgaaaaaaaaaaaaagaaatatatttctactcaaacttgctctagagcagcagaagttgttctttataaaactaattatcaagattatataaatgagagatacaattgctcaatgtgcatctttctttctaattcattttagttcttttaaaaacagggagaggcatgcagattgagaactcttcaaaagacattgttcctttctgtatataatttacaaccttttcattatattcccaacatttttatcactcatgtgatatgctgcaagcattttggtgagcagcacttcatgaataaaatgtatcagtgcctgtaaaatttgtaagaagaatacctcaggcatacttgaaatagagcacatttttgacacttcacacttataataattcatactccagaggcctttttcatcttgtgtatcagcaagctggaaaacctccatagccaggaagggtaaattccctatgtgccatgttcctaaaatcattgggctagggttgctcccttcccacacatgacattttcaaaagttaaaatctgctaatggcccctcaagcaaaacctttttgccttttggtgatactgtgacaccgactaagagttctcacactgtattaagtacgaaggtatatcccccagttacattactagtagtgcccaagagaggagaattgtctggcttaacttattcctagtttttgatcatctgctaaagaataataatacacgtttgcaaaataaaccatcagtgcacaaaagcttaacattatcatccaccccaaattgaactttaattggaatataatgaatacttggagtatttcttaaacatctcccacatccctaatgttttttcctaaaattccatgttttctgttatctcaacttacgattgaaagctgacctccaaagcaacacaaatactatgtataccacatattgaagtatagctgatcttgctgaagacattgataacttcctcattgcaaaaatcatcttcagttattttccatcttgttggaatacttactcaagcacttgaagctgctgagtcattcctttcattaactaaaaaaaaaatattgtgcacttatgttattccaggcagtgggaatacaataattaataataatttttaaaagagtctcaaagctcaaaggagtttacaacctagtggcaaaacagagtaattaccagataattataaatcagagtggtaatgtcataaaacagtgagaaaatattgcaataataggggctccagccccagacttcgggggttaggaaaagctcccatagggcattgcattccagttgagtctggaagaattagtcaagtcatccaggggaaggatttagggaaatggagttccagagataaatcagtatatacataatcccagaggcaagaaagaatagagaatttggggaacttcaagtagctcaggatggcgagagcttaagagtcagggccgggcgcggtggctcacacctgtaatcccagcactttgggaggcagaggagggtggctcatgaggtcaggagatcgagaccatcctggctaacatggtgaaaccccgtctctactaaaaatacaaaaaattagccaggtgtggtggcgggcgcctgtagtcccagctactcgggaggctgaggcaggagaatggcgtgaatccgggaggcggagcttgcagtgagccgagatcgcgccaccgtactccagcctgggtgacagagtgagactctgtctcaagaaaaacaatgataaactggactgtggctaaagaagagtgatcagagtagtcaaaggaattggggcaaagcagtgagagaagaggacagaggtctgaatacatttatcatgctaaagagtttggaactcatttggagaagaatggagtatcttgaaccactttcagcacagagacatgtgatcagtgtgactgcctcgtggagtactgattaaaggggtcaaaatcagaggtagaggaaaatatggggaggccattgtaggcatgagatgatggcagcttaaactagaatggttgtcagtaaagcacaaagagaagtagatggctagatttcacagctattcaggatgcagaagcaagagattttggtggtgtttagtggtctcctgaatgtgagtagtaacagagaggaaagaagtaaaggatgagcctcaggtttcttcatagagaccctcatgttcaagctaagttgcccagaaggcagttggatatgtaggtccagagctcaggagaaagaactagtttggaaggtaggtctactctggtttttattctacctctctggccactgcttctttgaacttgttttatttgacacacagatatagaccttatttctaattattccatcctcatacatattctctttcactctacacactcttccccatggatttcacgtacacactcagtgttaacgaccagcaatgtttgggttcctcacaaaaccactgtatttgggagatgatcctgggaaacaccaaaagaggagtcgaaaagtaatatagggaagggaaagtagcctataaagggtgaatttccaagcaagttaccactgggggtaaagagagctaaaactcactggggaagtctggtaaactctgcagaagacatgcctcagagttatccaacttgataggtgagggagtttatgtattaatacaccaatttcagtcagccattggtcaatggctatcagcctgcctcctccaggtacatgagtacatgggtagagaaggctgtgacactacgaaaaatatttagtcataaaaatgcaattgcaagtctgccctatgcagataaagcccatacacacataggtaggacaattacagaatctgttacaacatatgtgcacaactcccaaatctataccttcagcaaaagtttaatattgaaagtcaggttccactgtgaaactataaagtgccatctaaaatgagctgttgactaatgggaccaagaagagagaagtgaaaaccaaaatatggaaccaagcaaacataagagaaccagagaggtaaaagtaaagattaaacattgagagtacaggagatggaaacggcctagctacacaaagtgaattctaaggaccagtagtatcagcatcacttgagagagtattagaaatacagacctactgaattacaagccacagaagcaagatctccagttcttacgtatgcacattaaagcttaagaaacgcttttccttcttctttagagcttgtgtcaccataatgaagacttttaaaatgcattcctaggtgcttatatttgggtgggtgcccatatccattgcctgcaatccctaatcctcttaaatagcacccagatccactaaactctttaagccaaaaatctagactcctgtctctattacccaccattgacaatctctatgattctctgccaatgccacagtgtaggtctgtatcctttacaaaagataattgcaataactttttcactggtatcattgacttctgggtcttcctgccccaacttcacctccaaaatgacacagagcaattcttaaagtacaaactaccatactgttcctcacttaaataatagagtggttatccaacaactttgagacaaattcctaactacttagtctagtaccatgagctcctccatgatctggtatctgcttaccttcttgcaaatatactggcctagtatagttactgtaatttgagcaataaatttagtgctaaaattcctgtcaatcaactcataaagggcatgagggttacataatctttatctttaaaagtctggtgctttaaaattttcatttgctactctggacttaacagcaggttaaaaggccataaaagggccctctctctaagtatgatgtatcctgggttgtttccatgctccagcccataagctagtgcaaggatggtaatcctctgttaaaaacctgaattgttatgttcaagactgtcccttaatttcctgatatcctttatctggcatacagacaacagttgctctttttcttgaacacggaagtcataaatcagtcctgtcccttttcacacctagccccagccaggaactttgtcaaaggcaggagccatgagaacccatccagaataccttagtctgttttgcactgctatgaaagaatacctgggagtgggtcatttattaagaacagaaatttatttctcacagttctggaggcagtgaagtccaagatcaaggtgccaccatctgatgtaggctttcttgctgcatgctcacatggcaaaaggggtaagggtaagacaggagtgaactctatgccttcacatagcagaagagcagaagggggagaaccaattcctgtaagtcttttttaatagtagcattaatccataaatgaggccagagcccccacaatctaaacacctcctattaggccccatctctcaaaactgttgcattggatattaagtttcccacacataaattgtgggggccacattcaaaccatagcaccaaaaaggagggcaaatcagacaattaccattttatgatcaaatttttaaagagatgaaggtatttctggtattcaattttggatgactttcttacctgagccatgatataaggaaaatcaaataacattatgtacaatatctttaaaaggatttttcaacaataaatacattgtttgtatattttctttttaaaaaatagctttgttgaggtataattgatgttcaaaaattcgcatattttattggtgagtttgggcatatgcatacacatatgtgataccatcactacaatcaaggcaataaacatttccatcacttctaaaagtttacttgtgcccctgtggttgtgtgtgtgtgtgcatgtgtgtgtatgtgtgtgataaaaacacttaatatgagatctacccctcaacaactttttaagttcacaataccatattgttaaatatgcataggcaacaaatcaaaaatagacaattaggactacagcaaactaaaaagcaaagcgaaggaaataatcaacagagtgaaaaggtgaatatggaatgcaagaaaacatttgcaaaccatttatctgatagaaagttaatatccaaaatatataatgaactcctataatttaacagtctacaaaagcccaattttaaaacggacaaaggacttgagtagacattttttcattaaaaatcatataaatggccaccaggtgaatgaaaaggcatcaaacatcacaaatcatcaggaaagcgaaaataaaaaccacaatgagatatcacctcacacctcgtatcatagctattatcagaaaaacaaaagataagcgttggccagaatgtagagaaatagaaacttttcttcactgttggtgggaatgtaaaatggtgtagccattatggaaaaaaagtatggaagtttctaaaaaataaaaactagaacatatgatcctgcaatccaacttctggacatatgtccaaaagaatcaaaatcaggattttgaagcaatacctgcactcccaagtttattgcagcattatttacaatagtcaagatatggaaacaatctaaatgtttgtcagataaatggataaataaaatgtagtatatacatacatacaatggaatattattcagcctttaaaaagaaggaaatttaaccacaacacagatgaacctgcaggacgttatgctaagtgaaataagccagtcatagatgtacagatacacatgattccatttaaacaaactatcaaaaatagtcaaactcacagtagcagagaatagaatggtggtttccagggactgtggggagtaagaaaaagggagttgttgttcgatgggtttaaattctaattatgcaggatgaataagttctagcgatctgttgtatattatgtttgtatttacatttttaaaaccatagataaaggttaagggcatgatacttttgcaaccttaaataaaagcaactggactggaattggaaggcttggtttgcattccagattgcaatttgttgccagtaggaaccaaagcaagttaatctattaatgtcagtttcctcacacataaaatgtggataaaaatactcagtctaaatgttagtatgagaattgaactagccaacagatatgaaggcatctagaacagtgcccaacatacaataagcacaaaataaatattaatgtcttctttgtattcctcacacatcaaatattcatcagttaggatatttttcaggagtagaagttaattcccataataaattcaccatttagaaaaacaaagacaaaaagcacagaactctgcaatttctagaactacaacatggctaatgtgaaattgctcttgcaataacatctagcactgctcaacaaagattaaacacttaaaactatgtagtcagttcacaagaaaaaaataaatttttatataccagaaatgtggatttcaaagtcaaagtattgtaagtaaactagaaatcttacaaattctcaaagcaaaattctcactagttaatatagcagccaccccagggattgaaattaaaaataaaagtatatattgttttgttttatatttataatcaagtttattgagatataatttaaatataattataattatacatgatttattatatataaatatacaatttaccatataattataattatataatatataatatattattattatataatttataattgagatattgtataattataattatatgataaattatatataaattatggtacaccattatttatatataaattttggtgtgccatccaatgtattttggtaaatgtacacaccagctgccatcacattcaagacatagaatatttccaaattcccaaaaagtgcccatctgcccctacccgatcaattcctcttcccattcctagcccagacaaccaccgatctactttttatcactacaacctagctttgccatttctagaattacataaatggagtcatacagcatatctggcttattttgcttttgtgtctggcttctttcactcagcatatgtttttaaattcattaatcaagaatgcatcagtagtccattctttttattgctgagtaatattccattgtaggaatatacaatactttatgtatccattcaccagttgatgaacatttgggttgttcccattttttatctattacacataaagttttttttataaagctagttgtttttatttatcttagaaagaataccaaggaatgggattgctgagttgtatgataagcatacatttacctttttaagaaacggctagactgttttctaaagcagttatatcatttcatgttgtactagcaatgagtgagacttccagttgcttcatatctttatcaacctttgatactgtcagccttttgaattttagccattctgaagtagatgtgactttaatttgcatttccctaatgagtaatgaatgctgttgagcatcttttcataggccatttatgtatctccttttgtaaagtgtctgttcaaatattttgtctgttttttacactgggctgtttagcttttattattgatttgcaatattttcttaaatattcttgatgtggaactttggttttaatctgtaaaaaagatataaaatgaaggtttgtataagtgcaagtcaagaatttggtgttgagacattcttcataaaaccagaacctttgagaagggctgtatctctagttaaaaccctcaccaccatctctggaaaatggcaacaaaaaaaaaattgcctcagcttttcgtctctaaatttaaaaaacaaaaagtctcctgagaaaatgcaacctcaagatagtgtaacacatggattttgaatccaaatgtgccctccctagtgatggtggattttccaagttgaaacagtaacaaaattagctccgagccggtaatatccttagggtgactggcagaagcaaccagaaaaccaccatttatatgtttcaatagcccaggcctattattatttcccccataaagaaatccccactaaagatgttgacataattaggccgggcgtggtggtgcacgcctgcaatcccagcactttgggaggctgaggtgggtgggtcacctgagctcaggagttcgagaccagtctgaccaacatagtgaaaccctgtctctactaaatacaaaaaattagccaggcatggcagcgcatgcctgtaatctcagctacttgggaggctgaggcaggggccattgcactccagcagccttggcaacaagagcaaaactctgtctcaaaaaaaaaaaaaaaaaaaagttgagataattaaaaaaaaaagaacgaagaaatgatctatcttgaaaagcttcatatgacacacaaaagtaggaatagaccataaaatctttgagtttatagaaaaatatttttaagtattaaaatacatattagacattataaggaaagaacaatattctatgaaaaaataaaagacatatttgaaagtaaactgaatatgacttctataatgaaaaatatagttttgaggtctgtgagctgcctgattaggaggggaatttggagggtctttaaaatccaatttaatgttgccattctttgattctaagagtgaccaccgttttcagattctcccaatcatgctaaataaatggagacgttctgtataagttttgcccttgtgtgttgtcccaaagggttgcagacatgaggcaacagagctttgaccagcgactctagctacgtttaggcttttaaaatatctaactatttacatacaaaaaagtgtgaatgagaaacgatgacaaagtacaggtctcctcagaggcagagtaataagcatctaatactacctttgagctgatgcttgaattattccacatagcctggcaagttgtcatttagcctttcctggaccagctcggtgatgggaatttcactacctctagcagctttcagttcaattttggagctattttaattgagtattctccttatactaagccaaaatcagcgtgcttattatttctccattttttagttctgctctttaagttattcagaacaattttaatctctcttcaaaatagcatgtggaaaacagctataaccattcaacatccagatcaaatgttcccagttctctttactagtcacctggtgacatagctttgagtcctctgaccactctgatcactcttctttagccacaatccagtttatcattgtttttcttgaaagtaaaaaccaaaactaaacacagttttccttttgtagtcaaccactgaaaaattagggttgaatatttcaagatatataaagcaaaaatgttacaaatacaatgaatattttaaaaataaaatacagttatgatggaagaattcaatatacccccttaagaaactggaagagcagctggtcgcagtggctcacgcctgtaatcccagcactttgggaggccaaggtgggcagatcacctgaggtcgggagtttgagaccagcctgaccaacatggagaagtcccatctctactaaaaaaatacaaagttagccgggtgtggtggcacatgcctgtaatcccagctactggagaatcacttgaacccgggaggcagaggttgcggggagccgagatcacaccattgcactctagcctggggaacaagagcaaaactccatctcaaaaaaaaaaaaaaaaaaaaaaaattagcccggcagggtggggtgcacctgtagtcccagctaactgggaggccaaggtgggaggatgacctgagcctgggaggtcaaggcttcagtgagctgtgactgtaccactgcactccagcctgggcaagagagtaagaccctgtctcaaaaagaaaagaaaagaaaagcaagagagaaaatgacatataaaataaggagaaaaatggtaagtataacagtgaccttaaatattataaataatgagattaccttaaagtgtcagtgtgaaaaattccacaacctaccctacaaacaaggaatattcttttttttcttccaaaatgtatgggatatttaccaaaaataatgattaaataggaccttaataaacctgccatagaacttctatagaactgaacactaataacaaagagtaaaagattgtagccacttaaaaacgtaaaactttaatttggagtaactgcaattaaaatagaaccaaagccacatgagcaaactttttgcaaattaatggtactagtaagcctatatatgaaataaaagaatatcaaaaagcttgttccgatgactatttatagccttaaattctttttttctatataaaaatgtaaaaaagaaataaacgacatagtcaactcaaaaactgagaaatatcacagaaaaataaagtaaaataaagcaagagaaaggattttttttaactagaaagcaaaatcaagtaacgaggactagaactgacaaataaaaccaagagctaatacttttaaaggaccagtaaacttgccaacctctgggaaatctgaaagcaaaaagagaagccaaacaatggagattttaaaaatatatgaatactacatttattctaataaattggaaaatcttaattaaatggatgatttttaaaaggaaagtatgaatgagcaaaaatgaccaagcaaaggtaaaaaaaaataaataaaacaatactcatcgaagaaaaagtttgggacctaaatgttttatgagagaatgggggatgatctattaaaatattaaagaaaaaataattcctgtgtaatataagccactccaaaacataaagaaatgagtcctctaatttatttcatgaagcctgcaaaaccataattccaaatccttaaaaggagagtaacataaactgaggccaaatcacatacaagcccagaagcaaaacatcttaaataaactaatagcaaagccagtctacgagaggattttaaagtaattgaccatgaccaaaaatggtttcttttagaaatgcaaaattggtttaacttttggatgctcattaatgtattatcagcctgatagaagttgacagggaatctgataaaattcagtaaggattcatgattttaaaataataaaatctccttgcaaattagaaacaggagggtacatgctcaactttttttttctaaaaagacatctacccacatcattatacttaatggtgaaatattagagacattaccataattatttaaaatacatttagactataaagcacttaggagagtaggagccccaagttgggttgtgctcaccaccgcatctctagtgcctagcacagtgccagatgctcctaatttttcttctttctcactagcttctctttctcattctcttttgctggcttctcttcatcttcgcaacttctaaaggttgtctttgaatacttctttctgctctttgtactcacgtcccaggtaacttcatccactaccatggtttaaagatcatctgtatgctgatgactcatagtcatcatagagcacctgcattctaccttttatacctcaaagtctatctttttcacgcccaccaaccacactccagccacagtcaccttcttgtcccttgaacatgatgtccttgttctatcacagagtacttgcacctactgctctttctctggcaatggtctcccaccagatttgtatgatgcccttttccccttgtaaatttcatctcaaaagtctcctcctctgaaaggtatttttcagttttatagtggcatccccagtccatagtccttttctattgcatttctcaactatattttcttcataatcttatcacttattactatgcaaaactgtatttatttgtttatatatttgttgatggtctccatctgctggagtatgttcatttgaaggtaatgcatgtgtgactgcaaggattttgtgcattttaatcactgaagtttctccatggtctcgtgcatttattctttgaaatgacctttaaggccattttgtcaatatacaaaaattgttgaaatttttattggaattgcattaaccttatagactggaatatagcaggcacttaataaatcttttgaatagcaaatgagggaatttatgaagaatacagagctaacaattattacttttattcagtattatctcagaagttctagaaaatgccatgataaataaaagccccagagatttaaatattgcaaagacaaaattgcaattagttgcaaattatatgattatttttctacacattacaagacagtcatctaaaaacaaaacttatgagattcaataaggtggcaagttacaactcatttaaaaactggtatctttccaatatacaagaaatgactagttagaaaatattatggaaataacatcacattttacatagcaataaaatatatacaacacttagagacttaacaaaaatatatagaatgtatataaaagggaatataacactttacttaagggtacaaatgaatactaaatagaaagttatatcatgtccctttaaaggaatactcagtttcaaaattataatttttctcaaatgagtctgtaaggttaatataattacaataaaaattccaacagtatatttgattattgacaaaacgactttaaagatcgtttcagggaacaaaatacaataaaagctaagaatctcttgacagggaagaatattaagaatggacttgttctggccaggtgtggtggctcacgcctgtaatcccagcactttgggaggccgaggcgggtggatcacaaggtcaggagatccagaccatcctggctaacacggtgaaaccccgtctctactaaaaatacaaaatattagccgggtgtggtggcgggcgcctgtagtcccagctactggggaggctgaggcaggagaatggcgagaacctgggaggcggagcttgcagtgagccaagatagcgccactgcactctggcgtgggtgaaagagcgagactccgtctcaaaaaaaaaaaaaagaatggacttgttctgttgaatattaaaacctaaaaccactttaattaaaaatccaactattgccggattatacatgtgggacaatgaaactgaagagaaactctaaaacacaaaaatatataataattaatttatgataaagatagcattttaaatcatgagaaaatatttatataatcaacaatgttagaaaaacgaatgactttttttaaaagccaatcactcatctcatataccagattaaattacaaaacactaaaaatataaatggcatatcaaaataattaatcaattattccttgtctgaccccagttatatctatgttggcacttttcaccatatcctaggtgcctcttacacttttatctttatattccattttttctctctgtgtttcactgtatacactttatcctgagccgtcctacggttcaataatacttttttgtatttttacatgttgcgcttctttttgttttttatttgtaatactttaagtaagaaattgtttgaaataagacaataagagtctaaaaataaggagtcggtgggagagcaggagaccagagattattacagaatcaacctgacaataacctagacaaggaataggaggctgttcaccaccaccaagaggtccagtgcattttgctgtccttactgataggccatatttcaccttcttacaacagaaatatcatcagagactttatcaaaaactaggctgaaatccatatatacgacattcatagcattttattgatccaagtctagtatttacatgactgctttgttcattttgaggagtatatgtttataaatacatattaaatatggaattctacactctaagtaataaagaaggtttctagaaagaaaagaatgtctgcaattagttttcctctaagccaggactattgaaaactatgccattttgattctctgctcatttaggaaacagacaaaagacgaatatttaaaagttcaataattaaagggcaatcaacttatattgccctctttaaatccacagaactgaacttttcaagttattaacattaagctattatgcagatgaaagaataagaaattggtatcagcagactcaaaggagaatgtggatattctataaatccaggaacacatgacaatgttttcaagcacacagcaaaatgcctaagggctgaccaagtgggcgtacattatttttttagaaatagacttcaatataaattgccaggaggtggccatttatcgccaaagggtcagatggaaggaatgtggaatgtttccacatgtgttttaatgattcagtagtcaaggtaaagccgagtgctgttctcaaaaattactcctggggatgttacatatttaattcagtccagctggaaaaggttacaggatgtagtcctcaatttgaatgactattgcactcttaaaatgctgtttttgtgcaatgtaaggaacaattttgattgcagttttcagttaaaaggccttcctctctgaagacaaacttgtcaattgcatggaatctgaagcagccaattgaaggaaccaatcagcaaggcttgctgacagctgcacctgagtagccccacactgctgagtgagggggtagtcttaataccagcccagtggtatttgaactagtatacagtaagtccttacctaacatccttgataggttcttggaaactgtgactttaagagaaatgatgtagtataataaaatcaattttaccataggctaattgatataataaacaagagttaagttcttatggcttatttctagttacagaaatatcaccgaacttctaaataaaggcaaaaacacttctaatatcaaacaatgaagtacatgtaagcatgtgagctatacatacatttaagaaaaataaacaaagcaaaataattatttacttgcttattccagttcaggcttatgggttgccagagcccatcccagaagctcagggcacaaaggaggaaccaaccctggccaggatgccatcccatcgcagggtgcactaacacacacacacacacacacacacacacacacacacacacagcgcacttgctcaaaagtaggaccatttaaacaagccgataaacctaacatgcgatgcgtgtgtttgggatgtgggagaaaactgtagtatccagagaaaacccaaacagacttgaggagaatgtgcaaattccacacagacaggggcacccacctggaatcaaatttttttctcataacccaataatgaaaagacgttgaatgtaacgtcattattcaaggactactgtaagaactgcagccctgttttctggctgaaagaccatcatacaaactgtgaccaatagctattatgtacgtaaacgtgcgtttagttacatgcacattagataggaactttaatccttgtgaaacccagaacactcctattttaacttatgttaataaaatataatggaatccatggaagaggctctatggttaaggttgaaaaggcaattgcttgctaaatgccattttttaaattgcattttaaaagctgttctgaaatagctataacaaagataaaatttgccttaagctaaatgttgtcgaaattaaaaggtttgaaagaaagaaaacgagtcatcatccagatttttaaaaaatatgctgaatttgaagtttctttcaaagtacagtgtttcaatggggggagtccaatttttgtaaaattttacaaaaactgtattgccctaaaggcagcctactgcacacaaggatcacagtgacttttacttgttattctacatgattacttaaaatttttctgatttttttaccctcatctatcttctaacttgtctagttaactcttaagaatttcaaattttctttgaaagatgataggcaatatgagatgagagataatctacaaaagttacagatgctcacatgtataaaacagtcaaaatatcacaggtcaatgacataaactgcattaaataaattatgtttataggcatcagtagttgaaaatgctcaataattctgggctccttccccaaaatgtaagacttaagtacttcaaaggcattattctttactcatgaggatcagtggcttcatttagtaaaagaaaaaggaatggacccaggatcccagtaaataattactaactgatcgcaacgctcttttatctaatgaacaaccaacaaccaacagaaaacccttgattcacagaggagcaagtcctagctattattaagacagtcattttttacgcttttttaaaaaaatagtagaacaatacgtgttggtctaatctggaaggtaaagtatgctgacttattaaaaattcttaatggaaccacagcccccaaatcatttcccgttaggatgaaagttaacagctgccattagggctggtgtcaatttagagatctcttctcacttatgccagaacttataagaaaagcccatgaagaaatagcaattgctaaaataactacatcaataagccattctattcagacattgcaaacacacaagcccttgaaatcatcataccactgacccaccaaataagctatttttagccaatgaggattaccttctccaacaacaagaacaaaacaggccatttgatatattctttctggtttctagggctttttcactttcctacatactaatgaaacacagatatctaaaccatgccagttacatagtgatatttttactctagaattgtttgctaatcccaaccagttcaggaaaggctttattgataggattcagaatcacaaatgtagccatccaaagcctgcttactaacctaatacatagtcacgtgagagacaaacagaaaggaggatataaattttataaaaatctacatattggcaacaatccaggccttagttaactcatagctcaccttagcctcaagctacattatttgagcatggctgctttcctagaggcataaataccttagaaataatgaatgccacgaatacgcatgtatgttttatcagtgttgtttgcagagaagtcaagtttacaaatagaaaaaaataataaagtacataaaataaatttttacaaataatgccattttaactggatatgaactactttttccatgtagtataactggaatatattgtttaatatgccaagttctagatttagatgacttgaaatgaatatttatcaatagaatacttgcataaagtatagacttacaaaaaataaatgttaaaacatagatggaagaaaagaatgcttagatgtgtgccagcatgggagctgggtttatgtgccagcatgggagctgggcatccctccctccacaagactggcctgggaagggagcagcctgttatccagccacagcttctgcccaagggaggcctgcagccccacaaacctataacagcccagtgatctgggtacagaagccttagaacaaatcgagctgggcaggcctgctcctgaggcaggtaacagacaggattcagttgggggagtgtgagtttagcagaccccacaaccacgtgctggggtaaaaaacactggaccataagtgccacaccagctcagatcattgacgccaaaaactaacaaagaaataatctggacttaaattcaacacttgaccattggacctaacagacatgtacagaatacttcaccccacaaatacagaacatacattcttctatggacatgaaacatactccaagactgaccacatgttcaaccataaagcaagtcttaataaactcaaaagactgaaatcacactacacatactcttggaccacagtggactgaaaatagaaatcaatatcaagaagtgctctcaaaactacactattacataaaaactaaacaacttagccagcactttgggaggctgaggtgggcagatcacctgaggttgggacttcgagaccagcctgacgaacatgatgaaaccctgtctctactaaaaatacaaaaaaattcgccaggcatgctggcaggcgcctgtagtcccagctacatgggaggctgaggcaggagaattatttgaacctgggaggcagaggttgcagtgagccgagatcgcaccactggactccaccctgggcaacagagcaagactccatatctcaaaacaaaaaaacaaaaaacaaacaagcaaaactaaacaacttgctcctgaatgatattttggtaaaacatgaaattaaggcaaaagtcaaaacattatttgaaatgaatgataacagatgcacaacataccaaaggttttgtgatgcagtaaaagcagtgttaagggtaaagtttatagtgctaaacactaaatcagtaagttagaaagatatcaaattagcaaccaaacattacacctagaggaactagaagaacaagaactacctctaaatctaccagaagaaagaaattattaaaatgagactagcactgaatgaacttgagatgcaaaaatccatacaaaggatcaatgaaatgaaaaatttgttttttgaaaggataaacaaaatcaatacaccaataactagaataacaaagaaaagagagaagactcaaataaacgcaatcagaaaagacaaaggtgacattacaaccaatcccagagaaatacaaaagatcctcagagattatgaacacctctatgtacgcaaactagaaaatctagaggtagaccgggcacggtggttcacacctgtaatcccaacactttgggaggccgaggcgggcggattacctgaggtcaggagttcgggaccagcctggccaacacagtgaaaccccgtctctactgaaagtacaaaaattagccaggtgtggtggtggatgcctgtaatcccagctactcaggaggctaaggcaggagaattgcttgaacccgggaggcagaggttgtgagccgagatcgcaccattgcactccagcctgggtgacaagagcgatactccgtctcaaaacaaaaagaaaaaaagaaaatctagaggatatagataaattcctggaaacatacaacctcccaagattaaatcaggaagaaactgaaaccctgaacagactaataacaagttccataattgaatcagtaataaaaatcctacgaaacaaaaaaggtcctgtaccagatgtattcacaggttaattctaccacatgtacaaagaagacttggtaccaatccgattgaaattattccaaaaaaccgaggaggaaggactccttcctaattaattctacaaagccagcatcctactgataccaaaatctggcaaagacacaatagaaaaaagaaaactacacaggccaatatccctaatgaacatagacacaaaaattctcaaaaaaatacttgtaaacccaatctagcagaacatcaaaaagttaattcactatgatcaagtaggatttatttatgggatgcaaggttggttcaacatatgcaaatcaataaatgtaattcatcacataaacagaattacaaacaaaaaccatgtgatcatctcaacagacacagtaaaaccttttaatgaaatccaacatctcatgagaaaaatgctcaacaaactaggcattgaatgaacattcttcaaaataatgagagccatccatgacaaacactgtactgaatgggcaaaagctggaagcatcccccctgagaattagaacaatacaaggatgcccactctcaccactcctattcaacatagtactggaagtccaaaccagagcaatcaggctagagaaagaaataaaaggtatccaaacaggaaaagaagaagttaaattatctctccttgcttactatatgatgctatacttagaaagccctaaagactccaccaaaaggctcctaaaattgataagtaacttcagtaaagattcagaataaaaaaatcaatgtacaaaaattaatagcatttctatacaccaataacactcaagctgagagccaaatcaaaaatgccatcccatttactagagttacaagaaaaataaaatatttaggaatacatctaaccaaggaggtgaaagatctctgtaatgagaattacaaaacaccgctaaaagaaatcagaaatcacacaaacaagtggaaacacattccatgttcatgagtaggatgaataaatataattaaaatggccatactgcccaaagcaatctagatgcaatgctattcctatcaaactaccaacatcacttttcacagaattagataaaacttttctaaaattcatgtggaactaaaagagcctgaatagcccaagcaatcctaagcaaaaagaacaaaggtggaggcatcacattatccaacctcaaactacactacaaggctacagtaaccaaaacagcatggtactggtacaaaagcagacaaacagaccaatgggtcagaataaagtgctcagaaataaagcctacgaccatttaatcttcacctacaaccatctgatcttcaaaaaagttgacaataacaagcaatggggaaagaacttcctatttaataaatggtgctgggataactggctagccatatgcagaagagtgaaactggaccccttcctttcaccatatacaaaaataaactcaagatggattaaaaacttaaatggaagacctaaaactataaaaaccctagaagaaaacaagaaataccattctggacataggccttggcaaagatttcatgatgaagtctccaaaagcaattgtgacaaaaatgaaaactgacaagtgagacctatttatactaaagagcttctgcatagcaaagaaaactattaaccaagggactagacaacctacagaatgggagaaaatatttgcaaactatgcaaccaacggaggtctaatatgcagaatctataaggaacttaaacaaatcaacaagcaaaacacaactccgttaaaaaatggataaaggacatggacagacacttttcaagacatacacacagccaacaagcatatgaaaaaaatgctcaacctcactaatcgttagagaaattcaaattaaaaccacaatgagatactatctcacactagtcagaatggttatcattaaaaaatcgaaaaaataacagatgctggcaaggttgcagagaaaagggaatacttatatactgctggtgggagtgtaaattacttcagcccctgaaaaaagcagtttggagatttctcaaagaacttgaaacagaactaccattcgacccagcaatgccattattgggcatatacccaaaggaatagaaaccatgctatcataaagatacatgcatatatatgttcactgcagcaccattcgcaatagcaaagacagagaatcaacctaaatgcccatcaatggcagactgcctaaagaaatgtggtacatatacaccatggaatactatgtagccataaaaaggaatgaaatcatgtcctctgccgcaacatggatgtgactagaggccagcatcctgagcaaactaatgcaggaacagaaaaccagatacctcatgttctcatttataagtgggcctaaacattgagtacacatgaacataagtaggggaacaacagatgctggggactactagaaggtgaagggagggaggggagtaagggctgaaaaactacctattgggtactatgctcactgcctgggtaacaggttcacttgtaccccaaacctcagcatcatgccatatacctttgtaacaaacatgcacgggaaccccctggttccaaaataagttgaaaaaataaaataaaataagatgatgaagtcatgaaagaaaagatcaaagccataagacaaaacaaaatattatgacaaaaaaaagcgcattttgaaaaagaactaattgggacttccagaaatgaaaaatactttttgaaattagtcaaaggaggagtaaacagcatttgtttagaataaatactaaagacaaaatcgtgtatgggaagttacatcaagatttaactaagtcacaaaggcaatgtggagatataaagggatagaaaatatgaaagggtaaaaggcacagaatatatagctagaaggtccaacatgtatccagaggcaattccataaggaaagaacaagggaaaggtgaggtgattccccaccaccctcattttcttcaccaaccaccactattgcctcttcaccaggctctcctatagtcactcctagaaccactttgaagaatcagtgctatggcttggcagggtagcagtggagaagttcccccaagagattctgggagagctgcaatagttttcatcagctctttatgccccagcagtgctgtggtactgcaacgatacctcctcatgaaggccaagcatgactagccactgctgatttttggctcaggggaaatggagcgagcaacagtcctctcaagcaatatgagagagaggcaagaagtgaatttaaaagctttccctaaaaaatataaacccaccactgcacccgctgactgtggttcagcctaccattacccaactaacagcctttggttttgccaggagtattcctcagattgtatgttacttactctaatctatgcttgcttccttttatgtggtttctacagggctgatcttgggcgagggagccagccacctgtgctccttcgctaagttcgaaaattgaggacttgctatcttttctttcatattattgtattttcttactgtttgttgcagtttatttaaaaacaattgtcaccctgctgaacattcttgtttatttcagtaatacgtctgtagattattttgggttctttccatgtagaaaattgtatcatctgagaacggtagttttgcttctttgattacaatccctacagctgtttttcttgttgttgttgttttgttttttgtttgtttgcttgtttgtttcgagacagagtttcgctcttgttgcccaggctggagcgcagtggcatgatctcagctcactgcaacctctgcctcccaggttcacacgattctcctgcctcagcctcccaagtagctgggattacagaactgcaccaccacgcctggctaatttttttgtatttttagtagagacagggtttcatcatgttggccaggctgatctcgaactcctcaactcaggtgatccacccgcctcagcctcccaaagtgctgcgatcacaggcgtacgccactgcaactggccataatccctacagcttcttttgctatagctgtctaggcagctaaagccagacttaggctctggctgagtttcctatgacaacaccaaatagaagtcataaaaatgggcagtcttgtctggataatgtttcctaagtaaggcctcgctattttgtaatactctttatcaggttaggaaattcactttgatatctattttgctaagagtttttttatcataaattgttgaattttattaaatctattttcttcatctgctgacatgattatgttttttcatcttttacatgttaatgtggtgaattacattattagatgtttccaatgtcaaaacaaccttacaatcctaaaataaccaaacttagtcatgacataggaatattgtgcattgttggtttcatttgctaacaatgtgtttatgatttttacatccatattcatgagtgaggttgccctgtgattttcctttcttcttccgtccttatttagtatgggtattcaggtcatacttgccacataaaataagttggagaatctggggacaatttgtgaaagattagatttatcagctactgcagtgtttggtaaatcatctgagccttgcatattctttgcaggaagaatttttacattgaatgattcaacatttacagtggttataggaccactgttgtgtttcttgacttagttttggtaatatttttcaagcaatttgtccatttcaaacttgctggcatctgtcattatgtctcctatttattgcttatctgtacctcctttttctttcttcattagtcctggcagaagtttgtaaattttcttattcttatcaaaaataagctatatggcttttgactactatctctgttttctatttaatcaattctgcatatatatatagatattaatttccttcattctttgagtttgctctgttcttttactaacatcttaagttagaggcctaactcatttcaacatctttttctcttctactatacatatttaacgttatacatgtccatctaactattgatttagcaatgtctacaaaagcaatgtacattcttcagttttgaatattatattttacgtactagatctattcatctctaataatactttttactttaaaatctattttggccaatatttatagagctatatcagttttcctgtggttggtatttgcatgccatatgtttttccatcctttcactttcaatactctgtatttttgagttagatatgactctcataacatcatttagctgaatttttaaattcaattttgatctatatttcttgtaactgaaaagttagtccatcttaatttcacaattttatgttttccttactagttttcctgcttctttaattcctccccttctctcctttgccattttttgttaaaagttgattaaggtgctcttattactcaatccatttttttgtctttctacttttttggaaattaaaatctgtctatttgttcagtggtcattttgaataatttagcaaacatactaaattttccaatgtctaaaattaaacgatacttttaccttcctcctgaacaatgcaaagattctaaaatacttcaactccaaccacttacttttaaaattttgctaatattgtccaatattatgattctatgtagattttaaccccacaagtcagacattattatgacaacttataccacattttatggtatatatttatactatataactatacattgaccatacttttgcctgttactctgagtgaaatgggaagccaatgcaaagataagcagggcagtaaggctcaaagaagcttcgtgtcccgagatgctgatctttagggattatatcaaccagacctccttaccatcgggcttccagttaagtttggctagtgggaagaatgagcaggagatcaccgaatagagagagtttggagtgtttattctcctgcttcctctctgcttggctgcagtttagtagtcgctgacttcatctatctaggatcataggccctcttaggaaggatctcagacatagtgacagttcttccctggttctagtcatggtttcctcccctttctctttcagcctaggggtggcgatagcttcttactgttaccaacactgcgtacttcaccatcctttgattcccttaaccctgcctatcctgtataaataatgtttcattaaaaaaaaacaaaaaaaactcttcaattactccttggagtgtgctacctgcttcctgtttcctgctgagctccttatcaacataaaaagaatgggcatcaaaatacacactctttccattcatacttttcagtcgtatgtcctatttcccttccctactgcccccaaattctttacaacataaccgtataaatgcttggaattttctcctatactttttgccatcttgtgtaagagtggatgttaaagggattggacactaattcaatttattatcttttgcagttatttttcccatttgaagacagaactgcagctctaatcagagcaggaatagagtattttaaggtatttcttttttgctctgtcactcattctttttatgacaaggagaacagattgtaaatcaagtcttggacttcctctacttccttgtaaagaattttaacaatagttaatctaatctctgctgaaatatggcatgcacctgaggctgtcagagtgccacacagagaaaacattagttaagaattctacccctgccaatcaatgatagactggataaagaaaatgtggcacatatgcaccatggaatactatgcagccataaaaaagaatgagttaatgtcctttgcagggacatggatgaagctggaaaccatcatcctcagcaaactaacacaggaacagaaaaccaaacaccacatgctctcactcataagtgggagttgaacaatgagaacacatggacacagggaggggaacatcacacaccaaggcctgtcgggggtggggggcaaagggagggatagcattaggagaaatacctaatgtagatgatgggttgatgggtgcagcaaaccaccatggcacgtgtatacctatgtaacaaacctgcacagtctgcacatgtatcccagaacttaaagtataataaaaataaaaataaaatgttaaaaaaaaagaagaaaagaagaaacaatttaaaaaaaaaaagaattctactcccagcagtagaaaaaaatgcggcatttttctaagtggtgttttaggattattctatttaatggcttatgttattatctgcgtgaaacctgcaatccccaggaatcttagaattttagacttatgtttagaaatacagaagcaactggtccagtatttattttttctaatattctttcttctaagatcttggaaagataaacaagtagtcactgcttaggtatttctagtgtctgacagaacctcatatgagttttaaatattccattaacagtgtatttattactaaaaatgtgtctccatgtgctgaatcaaaatctgcacaaccaaaacatccaccagttggagccaataacactctcagaggcaagaagtctagtccaagcaatttttctctcctttatatgttaactcatttcatttccaggactcagcacagtgcctgcacataataggctatcaaagttattaaataatttgaatgaataaaatatttaaagacacctatatatcaagacctccttaggtcttttttaggacaatcatgcccaattcccttaatcatcttcaagtgatgctttctaaacatattataattgactgcattcatttgtacaaactcaatttgtacatgaccatctgaaaatgtgacaatcaggaccgaacaaatagctttagaaatgggttgacaagacagtgccaaaatgggactattctttcttttctttatttaaggtattgtatttctagtaatggaatctaagtatgtgtcagcatgtctgataaccccactattggcttaaatagaacttgtgcttaattaaaataaccacattttagcttatttattcattcactaacttattgcccagactattgtagacaatggaagtacagaatgaataagacaagccaaaggcctaccctgaacatgcaaccttttttaaagtttgagattgtttaaaaataaaaatgtattaatagacaaaactgacactgaataaataagtaaatgcataaacattatgatgctcagtaataagtgatattaaaaattaagtaaggtaaggagtttaaaaagggatgaggaagaggccacaataaattgaggtataaaggaagatctctcttaggagatgacatttgaacaaatacctgatagatataaagaaacaagcaatgcaaacctataagagagagagagcttctaggcaaaataattacatatggtgcgccctacaactggaatatctgaggaacaagaggccactgtggcaagcaaagagagaatacagggagggtgatagaagatgagtggtaggaaaggaatgaccagatcatgtagggctttgtataccatagtacaggattaggattttattccaggtattacggaaagccatcgtagggttttgagcaggagagtgatgctatctgatttacattttcaaaaaagtttctctggctactctgtgaagaggaaacaagagtagaagcaggaagactgaatagaaagcttttgtaacagacctagtgatagaggatgagtatttggcttagtactaacccaaggatagaggttttgtatcaatccctattatattattaagcttttaaaaatttttagaatgggtttttagatatagagaaaagttgcaaagatagtacagagagatcccgtatactccacacttagttttccctgttgtgaacattttttacattactatggtaaatctgtcacaactaatgaaacaaaattgatacgcaaatactaattgaagtccatactttattcagatttctttagtttttccctagtatattttttgtttccattccaggatcgcatccaggataccatattatatttagttgtcctgtttccttagtccactctagatggtgacagtttcacagaattgccctgtttttaatccccttgattgttttgaggagtactggtcaggacttttgtaggaatcccacattaaaagtttatttgatgttttactcacaattaaattggagcaatgggttttggggaggaagaccacagaagtaaaatgctattttcattctatcatatcaagagtacatgtcatcaatatgacttatcactggggatgagatagtatctggccggcttttccgctgtaaagttactcttttccctgctcttcccacttcattcactggaagcaagtcacaatgtgcaacccgcacttaaggggtggggatttatgccctacttccttgcccaggaagtatctatataaattatttgaaattcttctacatgagagatctgtctcttcttcttcatttatttatttattcaatcatgtgtttatatccgtttgagctcatgggtatttattttatatttttagttacaatccaatattatgttatttactattttgctcaaattacttcagctttagccatagggagctcctttagttggcccctgtgtcgttttgacatatttctatcattgttgctgttgttattgttgtcatttgtttgcatgttataggattttttaaagcactccttgttcctggcactatgaaatgatacaggctcattctatatattccctgatccagccctagaaccagccacttctccaaggagccctggttcctttcagtagagaatagtatttgaaaccaagagctggccattagctgtgttcatttccaccaaggtgttatatcttctagaccctctcatctaacagagaaaggaaatgtttttatagtaacctgtacatatacacatatctataaatatttctaaatatatcaaactatatctctgtgtgagttcatactgatttctccaaatctaatcctttaacacatacataattttagctttcaccccttgcttgtgtgtaacctcccactccaacagtaagaaacctggctcccaacatctgccattcatttacttaataattcaattccagtatacatatatagcagcatcaaaactgattatctgtaccccccatggcaaccaactttatcaactaaagtacaatgcttatgtgcagtttcttttgccctttgtttcacagtctccagtcatttctaaagttatttaggtacacacgttttcccatattcccatcagtgaagctatttcctatatttgtgatatagttggattcttttgtcatggcctgcattccatcctgggtatctggacctcctaaatgattttctaaataagccctaaacagggcttattttgcattccataatgcaaatgaggtcaaacatattttcatatgcctatttgccacctgcttttatttttttcttttctttttttttttttttttttgagacagtctcactctgcagctcaggctggagttcagtggcatgatctcggctcactgcaagctccgcctcccaggttcacgccattcttctgcctcagcctgctaagtagctgggactacaggcatctgccaccgcgcccggcttattttttgtatttttagtagagacggggtttcaccgtgttagccaggatggtctcgatctcctgaccttgtgatccgcctgcctcggcctcccaaagtgttcggattacaggcgtcagccaccgcgcccggccttgccaccatctgatttgctgtcttctttgatgaagtgcctgatcagatcgtttcctcattttttaattggggctgtttgtttacttattattgcattttaagagttctttatattttttagatatatgtcctaaatttatctggtatgtaatttgcaaatattttctcccagttggtgatttgtcttttcattctcttaacagtgtttttggtagagcaaaagtttttcattttaataaagcctaaactgtcgatttttttctttcatgaaccgtgcttttggtgtatctagaaatgtttcactgaacaaaagttcacatagattttctcccatgttttctttttagaaacattatagttttgcgttttacatttaagtctgtgatacattttgagttaatttttgtgtgaagtgtaagatttgagactgggttcatttttattttttgcatattgatgttcaattgttccagcaccattcattgaaaacactatccttacttccattaattgcctttgcaccgttgtcaaaattcagttgactgtatcttctattgtatcttgttaattttgacccatccttccatcctgtcaaaatggtttcgggtcttcattttgtcagtcagtatatcttctatcccagagtcaacaataatttaataggtatgttctccaacaaataattaagcagcatgttgaatagtttaatactatggacagagctctgatgcatttcactaggaacttcctccagatcgatgtttattccagaattgggatttttttttttttcttttctgctggttttttgtttgtttgttttttgttgttgttcttgttgtttgcttgttttttgagatggagttttgttccttcgcccagactggagtgcagtgacatgatctcagctcactgcaacctccgccttccagtttcaagcgattcccctgcctcagcctcccgagtagctgggatttcaggcacccaccaccacacctggctaatttttctatttttagtagagacagggttttgccctattgaccaggctggtctcgagctcctgacctcgtgatctgcctgcctcggcctcccaaagtgctaggattacgggtgtgagccccaccatgcccggcctctgctttttttatagttattcaaaatacacaaacagcgatggtatacatccatatgcaggatctgacagtttctaaaatcagaaagtactctggaagtatcttctcttatagctgaggtttcagttgctcttgtcaatggagtctattttaccctttccaatttgcaaagctacgtagctctcttttctccacatcatgggttaccatcctgtcacattcctgtactccttcctcatttgtgtagcatagaagataactaaaaacattccattacttacatttctagattttatcttcattaacactatccttttgggacaagatcacccttatgaatttgaccttgttcttgtattcttatttttaccttttagaaaatatcttttaaaatttgaactcagcagactaaagaaagacacatgacaattaaattaattgcatgattctgaactggatacttttgctgtagagaaatcattgggacaattgatgaaatatgaatgggatctgagaattaaatgatagtaatgtgttagtgttaatttcatcattttgatgtttttatagtctgtatgtagaataatatctttgtttttaggaaatacacacttacatgttcagggatgatggggcattgtgttagcaatttactcaaaatattcacagaaaatattctttgcactgaacttgcaacttttctgaaattttgtgatcgttttgaaattaaaatgtcttaatgaatacaatttttaaattccactaatcagacaaaatttaaggatatccacattagcttcttagaatgccccctccccctttccctcccacaaagaattatgcacaatcatgaaattggaaattcatttccagagtctcccatccccttctatccatattcccttttcggctttctatataagttatacgtgttttttttctttgatttttggaaatctttccttgtctaatcatgtcaatgaattttcaaatgccatggcaattcttgttctctcaaattccctataccttcaataaccatcaataggtaaaattaagtccagcacagtagctccccccacggcttccccacctactaagaaaaaaaaaattaccaggacagatggtaacatatttttcacatagactgggttttgcattcttccctttatccttactctttactgcgttttcctccctcctgactggggcttttatatagatatatatatttctaatttaaaagaatcaagccaggccggacgcggtggctcacgcctgtaatcccagcactttgggaggccgaggtgggcggatcacctgaggtcaggagttcgagaccagcctcaacatggagaaaccccatctctactaaaaatacaaaattagccagacgtggtggtgcatgcctgtaatcccagctactcgggaggctgaggtaggagaattgcttgaacctggcaggtggaggttgcggtgagccgagatcacgccattgcactccagcctgggcaacaagagcaaatctccatctcaaaaaaaaaaaaaaaaaagaatcaagccaacatgtcaccaaaatttttagagatcacatgatttaggaactctaaatacagagatttacttgagtcagagaaggtgttatgaaccagcctgcttaatccaagcagatctttgaatcaaaggactacttgggatatttttgagcaggagattttctaaaacttcttacttaccctgagtaaatattctcagtaagaacaacgcttaggacgacaatatttccccattctttcttggctgtttctgaagaaatagccacttcttattaggcctatggaagtagaaatggagccatagctggtcttaggttctctctctctctctttttctccttatctatttctatcactttctccatccgtctctcccatcttccctaccatttcttactatttatgtattcctcagagttcaagaaccaaggtggggctcttgcaattacatttaagaatgtaatctttgctatgttttgttttttttaaaaaaaaaaaaaaaaaaaaacccaaaacattgcaattcccatgtagcttctgctttgagtttattttatgtcatagaagaattattttaatatgcgtactgagaaggaaaaacaagttcgaaacactgaaaataaaaatacacaaaagggttttgacattgggcattacacaatgatccaggtttcataaaacttagagttgaacatgggaattacatgaccattcttccagaaagtgaaatcccattatatcaggcctatatgtaatgattgtttcacaataataatgtgaggtattaatcaaattggaaagccctgaccaatggcttataaagcaattcccccctcatttaacatcatccaactttaaaatgcatttgtatttacttcagagccttaaaaaaaaacctactggtggctcccttttatctctaaggtatgctgtgatgatacttttttccatatacgtaaagcacggaactaagcaaccatgtttacaagacaataaagagaaaaaaattgataacagtcacttaaaagaatcttaaccacaatatgttaacatttaaaagggtgccagagggcaataagataattcaaaaatagtgaaggaataagctaaaaataaccactgtataaaaatatgcactgactcagtataaattaatagatgactacccttttgatccaagctggaaaaacttgcttctcaggtacttgtcatgaaataggaacatcctattgcatctttcaaccaatctctatttcctgaaagcctgactttcaaaattgttctgactgtctctcatgccactttccagaaagtgacaaatgttaaccctttccgtgcaatcacatgatttttgaatatgagggagtaatccggctgagacagaataccagatgtaaatttaggttctcttcacaaaggctaaggagtttatgattcgcctgggtttaaattggaaagacgtactgccatgtccaacagaaactgctagctgacagccatatccattgtttcatcctagatgcccagctaaattatatttctcagctgtccttgcaggtagatgtggccataggctgaactttatccaataacatatgagcagaagagatacatgtcacttccaagcttggcccataaaagccctcccacgtgtgatcctccatgtcctgttccctttgctgtgtggtgttgaaagctgagcatggaagatgatggagccacagatgaaaggagcccaggcatcccaatcatcacaaacagcaaaactgcctgctgctggggagcatttcactgggttaagaaactgaaagttggagctttctcttccagcagctggcatcctcttaactaatacactacagttatcatcattatttgcagaggaccaaaggcagaggcatctcccgttacagagttgtcacaatcacaatctttcccacggtagaaattgcctgagactccatcattagacaatgccagagcaagagaaagtttttcttgtgccggcatcaaaggagtgaagtggaactctgcaccaaggaaggggtctcaacatgggtaatttgcccttcagacaagccaacaggtccatgcacccaggagagaataaatgctatactaacttcccaaaatcaatgtataatgcatgaatgtgtataactaagataatatatttactagaaagcaaattatatatatatttctctgtctctacatctctcagtgtatatacattctttacaatctcttcattacttcctctcacatggtataaaactttcattcactcattctgcaaaatactcattaagcaattaggaactggaaaatatttcatcagaagtgacatatgaaccattgctttcagttgttgaatcaattcactgagaaaaaaaaatgagcactgcaaaattcttatgcatgaatcccaggcaaaaactacattttataaagcaaagcaaatttttgatattctggctcagtgacagacagtcaaatatttctttgtttttgaatgagaaaagtcagtgactgtattcacaatccacatacaatatctaatacctacaactggaaacagaagttctttatttctggtaggagtgggtatctgggccaaacattacttgaaccatcaaagaatattaatatttgtcatgtgagcattaagtgctataggaaaaaacaaacacaaatctgagagagttcctgccttcaagagtctactatctgacaggggcaagaaaacagaacaagcttcaggcaagatttacccacacaggaagcgttagaaagagatataatctaacctggactttgaactatgggtctaagtagacacagcgaaatgaggacaatatttcaagaggacaatgaagtctcatgagaccaaactggttgatttgtacagaaaatggtgctgtccttgtttttgtacaagaacatcctgttagagacagtccatatttgttccctcctctgtggatgcactacacttgattcttgcctccattaacttgccttattgcactacactgacatcatccgtttacccctcccacttgatcgtgagctccccaaaggcaaggaccgattctagatcatgctcatatttatctccagcatttatctcagtgcgtagaaagagcagaggcccagtaaatgctattggcaagaagagatggacgaaagaatgaaagacaaatatttgcagccagctagacactcccctccgccgtcaatcacagcagtacaaggcgccaagtaaacacaaaaatatccttcaggatggtccaaccctggcgctaagatagtgctacaatgccagcacattcttcaattcaaagagaactgattccgctaaatagctcaacttacgtgccttctaaagtgtactgagtattcccagattttcttaccgagatgtctgtatatatgccttggaagcaaatcagtattgttgacaataatatcataatttcatccattatgattctcttgctctaatcacactattattttttaaatcgaacttctgagaactatgtacttaatgtagacagtttatcttatgaacttacctgcagataatagacacagttcaataataggttctaaagaattataccgtatgattttagtaatcagtgcatttgttatcagaatttgtcatagttgctccagctaaattacctttcagacgtggtacttcatatatggagatgatcaccggggatgattctggagaactcattaggacgctcaagtagttatcatggtatcaaaactgtccccccaaaaggaaaattctgccatatgccttatattcaaaactagagtttaggccgggtgcggtgcctcacgcctgtaatcccagcactttgggaggccgaggcaggcggatcacctgaggtcggaagttcgagaccagcctgaccaacatggagaaaccccgtctctactaaaaatacaaaattggccgggcgctgtggctcacgcctctaatcccagcactttgggaggccgaggcgggcggatcacgaggtcaggagatcgaaaccatcctggctaacacggtgaaaccccgtctctactaaaaatataaaaaattagccgggcgtagtggcgggcgcctgtagtcccagctactcgggaggctgaggcaggagaatggcgcgaaccggggaggcggagcttgaagtgagccgagatcgtgccactgcactccagcccgggcgacagagcgagactccgtctgaaaaaaaaaaaaaatacaaaatcagctgtgcatggtggcacatgcctgtaatcccagttactagggagggtgaggcagaagaatcgcttgaacctggaaggccgaggttgcggtgagaagagaccgcgccgttgcactccagcccaggcaacaagagcgaaactacgtctcaaaaaaaaaaaaaaaaaaaaaaatagagtttagagacataaacagggcttttagtcctagctacattggggagaaaaaaaatactcaactttaattatttaatcaaatcagtagttcagatttcttccaaatctgaagcaaaggaaaatacagatttaagttgggttattgggaacatagcattttgcgacatgtttaaagttttcagatttgctctatattagtttctaaattgaatagttggcctccagaggaataccagaagatttaagtaatgcttttttccaggttaaaaaaaaaaattttctgtggctatattaaaagaaatagccttgtttccctagagctagcttgtaaaaatgcatttttatgaactcaactgactttaaaaaatcttatgaacattatattttatttctccaatttcaaagttacttctcacattatatataaaccacttttactagttttaactaatgtaatgttttcataatttttgatattctttttcagtttgaataactaacacatttccatgaatcgacactatctacatgcttgtcattttaatgtttgcatatcattctttgtgttgatgtaccatagattattttgtccttctcaaaccagtgggtgtttttatccaacaggtatgttgggtacatattgagcaccctctaccctgttctgcttctctcctttttctgtttgttgtattacattttgaatggcaaaaggtatttaattttatacatttaattcgatctgtaatcaaaatctccatttcttcaataatcagaaatgcatctccactctgagtagcatggaaatataatatggcattccaaaccattttatgttcctttatattaactcttcattacaaccgaaattcattgcagtatacagtttgaggtttggcttgagtttacattaatgagtctccaaattgccttccagttttcccaaccagatatgttatatttgtgttccttctcccataattcactagcttctggtttttcacatatataattcttataagttgtaaatgtacctaaataatatggtttacatatggtttattaagcatgtcacataatctcatataatatcaatagctctttgtgtaaggcagaaaaactcttttttccaaatgaagaaacaaacgattcagaaagatgaaataaaatacccaaagttatgccagagtcatgattcttgtcccaattcaaagtcttttcatttcctcaccctgataaacatagtaatttgaatattttagtaagctctactatcctctgccattcagttgttttatatataactcaataccagtcagttctgtctatttagaatatactttaaagtttgaatatatttgttaagtctgttgggaccaaccaccatcattacatttttttaaaatatgtattagtattagccatgtattcttgcaggtgaaaatcagtattgtttcatttaaaatttatgaattatcctatgaagataccaattagattatgttatctgtaaaatagcttggaaaaatttccatctctactgtagttatgatatacaaccttatttgtccatgttttccttcattctttcatagtgttttattttattgtgtaataaattccatgtgcactaaattgtattacatcaaaattattttaaaggtattgtgaattgattttttatttattgtatcttcaagtcatccttcattaatatatcagtgtgaatatttgtgaattctcataacttatttggtcaatatactggaagagtctaagcagacaagttttcttaaaattcgtaaaaaatgatttgttttcccttttattgatctacctttaatgttgcttttctttgcatggggctattgcctacacttccaatgttatgtctaatgagagttgtttcaaatggcaatcccaaagatctctcttacagtcaactccattgtttttcatgtcatttctaggttttaaatgcaatctgtgcaggccgggtgcagtggcccatgcctgtaatcccagcactttgggaggctgaggctggtggatcacatgaggtcaggagtttaagaccagcctgaccaacagggagaaatcccgtctctactaaaaatacaaaattagccgggcatgagggcacatacctgtaatcccagctactcgggaggctgaggcaggagaatcacttgaacctgggaggcagaggttgcagtgagctgagattgcaccactgcactccagcctgggtaacaagagtgaaactccgtctcaaaaaaaaaaaaaaaaaaatacaatctgtgaatatttgattttcagtttaaattaataagagatgttttgtatggtttttggcatatactaaaatagttacgtaatattttacattttagtgtgtgataaactgcaaaggtaaaccataaataatgccggggttcattcatgtattcattcaacaaacttttgctgagctctgctgtcagcactggtggagatgcaccggtgaagtaagcagatgaagtctttgctcttatcaagctcaattttcactggaattacggtcaaaatggaaaatgattctaatgtaataacattatgtatgctaaaattgtatttaagaattctggatccacggtagggaataaaagggttaacagtggatctgtaatttgactcctttcaccttagggatattttaattggttttgatcccaaccagacctctttattaaaacactgaaagaatttactagctagaagataaactcctccagatcttatctaaagagttcttttctcacagtatacttgatctgtttggattgtttcttctaaataactagtttatgtattaatgagctgactgaagaatgcaacctaggccttctggctatatggctagcagaatacaaaaacaagaggccccaaaactaagtgaatttcttgggctaacttttaccactcacagttgtccttgttattccacaccaacatacactgacatggaaaggggattaggaagctgcagctcatggacctggagcatttcaatatcaatgtgctgttcactgcggcttcttttgggtatcctttgctaatcattggcaaatcacagttctgggtaagatctctgtcttgtataaatctgattgacaattcacctctgtatgtaatcataactaaaacgtgtcatccgggtttttcccaactcctgtcagtagatacagccccgtatgctttctaaccaagaggacgataacaattcaattcaacaaacacatattaagtatctgagaatacatcaggcactgagaatacaaagacaaatcaattatgtttctggcctccattcaattatagaccactgagtcaacagactcagacccttgaatgctggagaatgaaatttgtcttgcggttatgagttaggtatgaggtgtgcctaaaatgaatgcttgtggtcaacacactcaccaaactgcagtttccctcaaaatccaaatcccaccaccaccaacgtcttcaccattcatataacagaggttctggcataatttctgtttgtttaacccttttccttaatgaaacaggagtcttgctggagatattttacagaagctaccagtgcccaactctagccccagggcttccccgggagttctcctaggtgagttcctacataaactgcatcccatgtttcctgcccgcaggcattctttggttgtagacgcctgctgggcctgctctgagaggaccccccaactccgggtctgagcccaatggaccacaggctttcttctattttattgactttcctctttttccctctcttatttccccagtctctcaccatagttcttcagatcaccttgcaaataaataatctgcacatgtatccttatctctgggtctaatttgggagaatccaaagtaagacaataggaatttttgcaattttcttgcctgtgtgcagtcacttctccccaggattaggtcccaccccaatccccttagccaatatccaaagatctgttaaagtcgagagaaacaaaccgaccataatattccccttgttctcgacagagtggctaatttgggtgtctctaatagactcatttgctgcagcttctttaggcactgcacattagactaatgtttaacagatcagaccatttctaaagccagatgacgtcttacagccctgataccactatgtaagtttctctcacttactcaccacaataagctgcagccctatataacataacattttcagcaatgtattgttcatacctgtccattgtttgtctccttcattacataatagtcttttaagaatgcagaccattttgtattcagtgcctgacacagaggctttcaaaaaatagtccacatataaatgaatgaatagccaatatcccactaaaatctccaaacacggcgtccaacaagcttttcaacctcagcatattaacaaccaaattcatcatctcctccgccctaagctgtccgctcttttgtttgacttcatacttcagtgaatggtattttcattgtttttatctcactgatttatgctgaaagtttctataacacgcaaattatgtattccttaatgatttggtagaaatttcatgcaaactatatggatctggtggctactttagggatagatctttgacaaattcttcgttttttttcctatggatagtagttgtactgcattacatagtatgcgatttttatatttttatttgtgatttatttattttttaattaattgagccactgatgtatacattttgtcaattttggtcatgaattatctactagttctcaatctcttcatagttttctattttatgtatgtatttcagtgtagtttgtccctttccttattcttttatttttattttttctgtattttatgttatttttctgtgttttctgtgttctgaattcattgtttttgtatttcttattctctttttatatttcttatcttattactatgcatattcagagagaaaggaatttaaccgtacttactgatacacattaattttgatgttacatttatgttttttattgctattattgtactggatttccttcttgatccagaaattatttagagagcgctccatttccatgtggatgtcctgtgttacaacttttaacatttctactgatcttaaaatgtagtattggtttagtgcaaaaataattgcagtttttgccattgaaagtaatgacaaaaaccacaattacttttgttatcttagtgtctctgtgtccacatatgtgattattttcttttttttcttcttttttttttttttttttgtttgagatggagtttcgctcttgttgcccaggctggagtgcaatggtgcaatctcggctcactgcaacctccgcctcccgggttcgagcgattctcccgcctcagcctcctgagtaggtaggattacaggcacccgccaccatgcccagctaattttttgtatttttagtagagacggggtttcactatgttggccaggctggtcttaaactcctgacctcaggcgatccaccagcctcggcctcccaaagtgctgggattacaggtgtgagccaccatgcccggccactgtgattattctctatttaaaaaatttatgcagacttaacaataaaatatattattctaccctaaaataaaattttctttttctttttgcatggttaaataatgtaatttctacttcaagtctttgttttctttatttttttctgagaataaacagatcccaattatggggaagggttcctgagaaccagcattagaggaataatactatactgaggtagatttgtgggtgtaatatcaagtgacgggaaagtggataaaaaatatgaatgtcaaagaggaaagtgacacgtgagcagagtaaacgtctctaatgacactcagaaatctgtccaggttttttatttttttatttttttaaatgtttgtggtactatagttgttacacgtgaattcaacattttggtttgggttgtttatcttttactgtgataatcaatttgcttgtaaaatttactttctccaataccaaaataacaactcttagcctcatattctacattaacgaacagaccttagtgatccaattattttttgtgtataaatccacattcatcttatatgtcttgttgtgattttgtattttaatatagctgttgacctttcttatttgcatttaatgttatgattgattttatatcattctctatcactctgtgttcattttttgatgctattgacttgctctttgtattcatgtttctctagatgacttcaaaatgcgtacactgagccagaaaataatttgatctacttctctaacatcattatatgccactaacatttgtctgaaactttaagtttcatacagtatttttataaagcattattgtgtgcatattaatccaattgcctccaatatttcctaatagaaataacaattgctattcccagtacttgccctgtcttaatcttgcatctgagcaaccagagaatattactaatgtgggtgggcctcatccaattaattaaagacctacatagaatgaaaaggctgaataagaggaaactcctgctgcctgactgctttgagttgggtcattggttctttcctctcttcagactcaaactgaaacatcagctctttctgggtctcaggccggccagcatttgaactgaattactccattgactctcctgggccttcagcttgctaatttcaaatcttgggacatgtcagctttcataactgtgtgatccaatttcttttttcttttggagacggagtctcgctctgtcgcccaggctggagtgcagtagcgtcatctcggctcactgcaacctccgcctcccgggttcaagccattctcctgcctcagcctcctgaatagctgggactacaggcgcacgacgccatgcccggctaatttttttgtattttttagtagagacggggtttcaccgtgttgcccaggctggtctcaaactcctgacctcaggtgatcctcccgacttggcctcccaaactgctagaattacaggggtgagccactgcgcccggcaccaatttcttatatctttgtcatatatatatgacaagcaatcctgaattgttaatgttgggaatgccatctgccatattattcaaatatcagaagaggctcaaatgatctctgttatacgttggcaataatagcaggagtttcttcctaaattttaactatgtcctactgtgttgtcctcagtagaaaaggatatccatgctccgtgaaaaatttcatcatatttctgaagaccatatttaaatcctcctcaggtgttctctcctttattctgaagcatttcactttcttcgtcctctcgtcacaggtcttaactttctttctttgttttcacatgaaccctagcaatgtcctcccctatcctttatgttttataagtaacgaatcacacagcactcaattaagcatgtaagtctgtctccctgtattgtggtcagtttgttacttgttagaatccaggtatcatttcctgatttccttatatctaaacagatgttccctgctctttctctctgggcctattttattcctgccctggtcattctttccgccagtgacttctccagtgtaccagcttcactttaaattctgatacttatgtctacatgtgccagtgcaaccattattatagtcatccatttaacatgtaaattactcaattgtgtcaaactggtcagaaataggaacagaactggccaacgaacagagttacctatagaccttgtcaaaggtttctgttcactctcaccctctgctcagcttatttttcactgttcttttaaggaacatcccgtactctatcacccacgagaatatcaaagaacttattcccaaactaaccattaaaggatcccacttaacaatctatctaggggatagcagtgcatgaatacaccccaatctgaattatattcctcaggaaaatgggtagcagttcatagccatctagcatgcacagtgttcccttccatctatatgagttttcttccagtcatttgagattactgttatcacctctctttcatttaccaagcctgtctctctgtcatagaaggaaattcgatttgagaatgcttgcttttctgaagccacacttgttaccgaacaatatgctccataactcagggtatgtgcaatttgatcttatgataaatcattctcttatttgccatatattttgtaaaaagcttatttagtgatgtacagtttcattttaagtactggcaatcaatattgcaatgttttcacatttgtatttgcatcttttatgagtttgcaaaagtatactaagctttgagcccacttatcataggatgaaaataaagtgcctctctttaatttgactcctgacttcttatacagctaagcagatgagcttaacagagctggaaaagggactgttgttgcttatataaacagctaggtctgcactgtaatctttagattttttttttttttagaacaggcagctatttcagccaatgcttctttcatggaagaattcataataaaaattgtgtgttcatcatgcatgttatcttaaaactgcagtcccctttcagtggcaaagaacatttggattttgtttattcttttaaaatttggacaagtaacgcatgccctgagtaaaaaataaaataatctgaaggatttataatgaaaaatgactcctaccctctgccatgcacagacacacatcagtcccactctccagaagcaaacttttaataataggtttaatttttatttttttctagtaattctcttcccaactctttataaaatttatctcactctatcctccttccaatttggggtagtattaattttagtcttcttggaagggtttcactttctaaattgaaaattgtctttccttttattagtctttccattgtctctgatcttccagagcgctacagagaaatgtgatttcatacattttctgcaggtaaattcctgcccctgccctcaaaccttctaggatcttcttttatctactgtgtcctaaaattttataatgtgtgtaaattacatttaattaaattataatgtgtataaattaaacatttataatgtctttttccattcatttctccatattcattggatcctttcaatataatgcatgtatcttttttgcagctttaggaaatgaatttccagtatgtctttatttcttcccctttattttccattctctctagaactgctattagctagatgttagttctcccacatatatcctacgcgttgtttatcttttctcacatttgctacagattttctctctattctgagacgtcattggctccatcttctaaaactcctatttgaaattatacattggcaatcatgtttaatgcctaagagctctttcttactctttcattttcttttccatacttatttgcttttgtgttatagtcagtatctcctcatcactctgaggatactaactatagacttttcatgtgttaatctgtttccagaaccacctgttttttccaggatcaactggtctctgatctctgttatctcttaatctgttgctgtttttgtcacatgtctgctggtctttggttatgctttcataattaaagtcagttggtggcctacatgtagatcttaccctgctagactttttactggataaagattctttgcacatagatggggattgttaactgggagattgcattttagaaggcctccaattttgagaatagggataccagcctacaccacagtagtcttatttcttcccaggaaattttttcgtttttattaaataaaagtatttccagtttgtcaagtttgttcatatgtttttttggttcattttgtttttgagacaggatctcgctctgtcacacaggctagagtgcagtggcgggattgtagctcactatcaatccgaactgctgggctcaagtgatcctctcacctcagactcccgagtagccaggactacaggtacaggccaccgtgcccagctaactttttcctttcttttttttgagacggagtctcactctgtcccccaggctggagtgcaatagcgtgatctcggctcactgcaacctccacctcctgggttcaagtgattctcccacctcagcctcccgagtagctgggattacaggcacctgccatcatgcctggctaattttgtatttttgtagagacagggtttcaccatgttggccaggctgatcttgaactcctgacctcaggtgatccgcctcaaaattgaactcctgacctcaggtgcctcggcctctcaaagtgctgggattacaggcgtgagccaccacgcctggcctacttttttccatttctctgtggagacagggtctttttatgttgcccaggctgttcttgaactcctgacctcaagcaattcccctgccttggcctcctaaatcactggaattacaggtatgagctaccatgccatttcatatgttttttattttatctaagagtaaaaagctgaatgacttaccctctgcctgaatgaacagtgtgagggtgagatattggattatggtgagtcaactggtacaatccattctgtagctaatgttttgtataatacttcccccacatccactctcttttaacgttacctttccaactgccaacttccattattcctgctaactatgagcctagaactctccaagaatcatctgggaaaatcaactttccctcttcttacagactcctgctgcatttcctagcctgctgttttccactttgttttgtctgtcaacacacatacatcctctttcttggatggcatacatttctttcttctaaaatctgagattctcttccatatttggggcttattcctttactattattttattgccctctcagcacggagggcaaaaacaaaaaacaaaaaacaaaaaacaaacaaaacaaacaaacaaaaaaaaacacctaggtctagtctgccttctggaactagaagccaggatagattcttctgttactcttccagtaatgaagaaatgcattagtctacatcagtgacaaacaatgtgtgggcactggaacatgggcatcggcatcagctgtaaatgcattagaaatgcaattttttcagtccccctgagtgagaaagtcttggggtagagcccagtgttctgtgtccaacaagacgtgatttgttgcatgctcacatttgagaatctctaactacacgcatgcttatccatctccctatggctgaggacacctatttgcacctccattaggcagggtctcttgagtccagcctgattcccaaaagttgcattcctcttccgtcatctaagaaccactgatttccacatgaaggccaagccctctctcaagtcctaggtgcaaaaaaaatacagcagcacagtctcagccgtgacattgggacccagtgtggagcctttgactcaccttgtttcaattcccatattaatatcccatttgtgataaccgaacatctgccttcaaccctgttttcataatcatactaatgtctcagaacctccaggagactgtgctactagctcctgctccagtggctttggttattcctgatataaaattcagcaaagtaggtggaaatatgtagcctgcttgacttcatctctctttccagattatttatcgtgatgttctgcccacttgtcaaaacacctagatactgtgttttcctgccgtgtggtattgcatcttctactggcacttgtccttcggtctaacaactcaggcctgatggtgatccaatatgtaaccataaaggagaaatcaaccagtaaccttggtagcatttactctgcaccctcatcaaagaagctgactggtcacccacaaaatcgattggcaacggacacacgcaattatgtgtggcatgccatttttagagtgccatttgtgagtacattcagactggatctaaggaggaaaagtgcatttgccaggtgacctgcagagcagcctgctggggaacggtaaataaggggaatactgacctttcagtcccaggaaatgacacattggcctccctcatgggagtttctctcacctgctttgatagaggccatcctgctccatctgtagtgctattggcagggatccatagagtttatggcaaacagcaatgagcaattatctcacactgagcaaaatagtgggaaagagctccagagaagaggaaagaaaccccctggataacgtgcaggtgagaactaagctctgatttcttttatcttgccgagattcctatctaagggatctggggagacatgccctaccaaccataaattctcatcagatggcttttatttaaacctatatatcattacttactttccagtctgactctggcataacattacgtgacaaagaagaaagtccaagtattttatcccaaaacatgtttctttgccatatatatataaatataaataaatatatattcgttgttgtatatatatatatatatatatttgttgttgtttgtttgtttttctttttgagacagagtttcactcttgttacccaggctggagtgcaatggcgcaatttcagctcactgcaacctccgcctccagggttcaagcaattctcctgcctcagcctcccaagtagctggtattccaggtgcccaccaccacacctggctaattttttgtatttttagtagagatggggtttcaccatgttggccaggctggtctcaaactcctgacctcatgatccagccgcctcagcctcccaagtgctgggattacaggagtgagctgccgcggcctctttgccttttttttttttgagacggagttttgctcttctctcccaggctggagtgcaatgatgcaatctcggctcactgcaacctccgtgtcccgggttcaagcagttctcctgcttcagcctcccaaatagctgggattacaagcgcgcgccaccacacccgactaatgtttgtttttctatttttagtagagacggggtttcaccatgttggtcaggctggtctcgaactcctgacctcaggtgatccgcctgcctcagcctcccaaagtgctgggattacaggcgtgagccaccgcgccctgccccgtctttgccatattttgaaacagccctgcaaagctgtcttttgtgggggaaaatctgcatctgtaaagaatctccattaacattgccagatctttttcttccaggccctcccagccctgaagagattaactaagagtctagcaccttttaaaggtctgaggaggaaacatctgtcatctattctctctaagggcaaccactgtaagacttcaaaagaaccttggtctccacaatcttttgtcttaacctgaacatttcctttctatcatcctaggtctttagacaaactcatccaattgtcaaccagaaaatgtgtaaatttacctggagcctggagccccaccccctaactttgagttgtcctgcctttctggaccaaaccaaagtatttcttaaatgtatttgattgatgtcccatgcctccctaaaatgtataaaaccaagctgcaccccaaccaccttgggcacgtgtcctcaggacctcctgagggctgtgtcgcaggccacggtcactcatatttggctcagaataaatctcttcaaatattttacagagtttgattcttttcatcaacacaggtttcctgcaacctaccaaaccataaccagtgtgtttgctccacttgaccttcccctcgttccctggatctgaaaactgtaaaggtgacttcttgttcaatgcatatttttttcttccctgtattaatagaacaaagggaatttctgattctagggcatgcaatctaatgaacgaagggatcttttttgctttaagagaaacactcaatgaagtcattaagagataaaacatgataaccaaggccctgatttctagtccaattaatagtataatgagcattatggattaaaatcctttttggttcagatattgtataatttattcagtgaaagtgatggatgggcaattgaaagaatgttatcgcaaataaaatttccaggtggaataatttttttttaagaattcacacaatcaagctattatcagtaacatatcaaggtgccagaaaaacatactatgagagggagggataatgtaccattcaacttactgaatctctggcaatttgacatggcctagagaatcctgctatgtggatttatatatacatttccatttactgcttgaataaaaatataaacaatttgagtgtttattcttggaaaacattgtactaggtactggggagttacaaaaataagcatatttgtattctgaatgagatcactgaaatattgctgataaaaaatacaggaacacaatgaagagaaaccgtgaaacgcactggggtgctagcaatgttttgctgtagggaggcaacaactccttgtgcccccatgcaccacgtcttcaatactcatcaattccaaaagaggagtgtaaatgtggtgttggccgggcgcagtgactcacgcctgtaatcccagcactttgggaggcggaggtgggcagatcacctgaggccgggagttcgagaccagcctgaccaacatggagaaaccctatctctactaaaaatacaaaattagtcgggtgtggtggtacatgcctgtaatcccagttacttgggaggctgaggcaggagaatcgcttggacctgggaggcggaggttgcagtgagccaagatcgcgccattgcactccagcctgggcaacaagaatgaaactctgtctcaaaaaaaaaaagtggtgttacctacttttcaatgcacctcacccaaccctctggctattacttaaatggtttgtatttttaattcttgtctgcaaaaacattaggaaaaatggataaattacagagagaaaataaaaagacttcacattgtaatatttccttttcttatttttttgtttctattcctattatttgttatatattatagaaattcaaggggaaaaagagctaaaatcattataatttctggacactcatttttgttgcaatgtttcttgtcagaaagcataggtaatcactggaatgacaacaatgtacggatttcctatcccgaaagttactttgcatttcacgggacttgtagaatatgagagagtcactacataaagttgtctaagttgttcattatacaaatctagggtacaatattcatagtctattatgtgaatgggcaacctttggagtcatggatttttgcactcctgaaagttgcttaacttcatagaggtgatttggatgcaaatgtggaagtatactctagcagaatgcctgaccatttcattatttgtatccatatgcctgaaatgcaccatcaagtggtattttcattctatcaaatattatcactataacttgctgctatttaaatgaaaatctcttatttgaaacctctgtcttcatcgtcccaccctccagctaccatactatacaaggtaggttggaaagaagcatgtgactcaatggcatgcctggcttatctctagtattagtaaagacactggatctatgacaatttcattaaaaaacagacaacatttatagccataatccacttcatgcctggaaggaagatacccttcacaaacagcattgcataatccaggaaaacaaacaagtatgtcccagaaacttctaggaaatgaatgcaaaatacaccatacacatattgaaggtgaatttgggaaagatgatttttcactgattcctcgtttccctaagtagtaaaagtgtttcataatctctcagtccttgtcctcttgtaacagtcaagttctgattaccagtggcaggagcatgagcacagatgcaaaacactgttcaatttgcatgctttttcctgatttctgaagtggtatttaaagccagtattctaaacacaagagtcagagagctgaaagttagttttaagtaagcttgagaaaattggtttcatttctatcttttggtaggatatcaatccagtagttttctgttctgggaaagcaaacataatccactaacctagtgaaatcctttgaaacgtggtcccctccatggacaaggggaagtgacacaggtcatctgttcatctaacaatttccctgaccaagtctaacttcaggcattttgcacaagtatcatttttaggcatgccatgtctttatttggtcctgtttctattaacttctaaaaacatataaatagcggaggtttcaaagtccttgagggaacaaccaatcctccaagtctaccccaaaaatctatgttcagggttaactgaccacagtcttcacttgggacacaaaaggatatgacatagtgtaagagacaacaatgtggactccagggaagcagagggagctcagtaatgaataattacaattaaacaggctcaaggaaagcaactgggacaagccactagggagacctattgaaaaggaaatgtgctgggcatggtggctcacacctgtaatcccagcactttaggaggccaagacaggcggatcacaaggtcagcagttcgagaccagcctggccaacatagcttactaaaaatacgaaaattagccgggcgtggtggcgggcgactgtaatgccagctactcgggaggctgaggcaggagaattgcttgaacctgggaagcagaggctgcagtaagctgacattgtaccactgtgctccagcctgggcaacaagagcaagactctgtctcaaaaaaaaaaaaaaaaaaaaaaatagaaaatgaaatgtaacttggtgtaaaggagagaaaagtggtttcagaaatagaataatttgtttcaaatctcaagcccactacttactacctggatgaccttgagttagtcactaaaactctgagactcagtttcctcagctgtaaaattgagataataattcctgttctgtcagctccagcatagtagggttggtgagtgggcaaaaattaaacagtagatgcaaatgtattttctgaacaacgatgaactatacaaaacaaagaaattcattttatgagagagagcggtcataggactgtaaaaaacaatccttgaagtataataataataataaaatgtgaccggccgggcgtggtgggtgacacctgtaatcccagcactttgggaggccgtggtgggcggatcacctgaggtcaggagttcgagaccagcctaaccaacacagtgaaaccccatcactactaaaaatacaagaaattagctgagtgtggtggtgcgcgcctgtaatcgcagctactcgggaggctgaggcaggaggatcgcttgaacccaggaggcagaggttgcagtgagccgagatcgcaccattgcactccagcttgggcaacaagagcgaaagtcagtctcaaaaataaaataaaataaaataaaataaattgcgaccatactggtaggaaaaaaaaaaagcaagagaaaaccagaaaaaagaacaaggttactcatcattccaatcccaagatatttggtgagcacatctttggtcccaaaggagtcaatactaagccttaatagaaatcattttctcttatcccttgtaaactttcgtattcactaatgtttagaagaagcaataacttattaaataaaagtctaccagtagcagagactattagttgcctactgcacattcactcttcttcctcataacagaaaccttgaattactaatgacaccaatatatgaaggaagaaagagaggacaatttaaagagacagagggaggaagaaggaaaagagtgaggaagcccgcaattctcagcatactatagatagtgatagccaatgagatagaagcaacgtctctaggtggggcatctaggaactcattaaaggggactgattcaagtgacatcatgtatctttccttcttccggctgcccagaacatggctgtgaagattgaagttgcagcagccatctttcacatatggaagccaagaactaacgtggtaaggagaatgatcaaaagagcagagcaggcgaaaccagcatatctgccctggaccaccacccctaaactttttttacacgagagaaaaataaacttttatttcatttaagtcaccacgatttggttttacatgtttcttttcgttcttattaatactccatccatttattacacagaataatgtattacagatgtttttatttccaatttcactgttactatcatgataatatgctattcacatgttattatataatcaagatttaaaactcattgataagttcctattttataaagctaaacttgggtcaaataagatatcacatcattacatccaagattatttcacatgaaattccctgtcccattatcttaattaacatccataagtttcattttgcttttctatttttttaatattacaggcaaagccagaacatattctattggcttgcataggaattaatgttgccaagacagctggagaagactatgagagctcattggaccttgcagtgaagctttgtgtgtactcagggaaaacagctgagaactatgaggcccaatttacataataaggacaaacttgcatttcaaagccacacttagttcaagcagccagtcttcatacagtgataacaatatctagtagcagctagtccaactacctctctaaatatttatgccagatttcaatgggaagctactcatcaacctggactagaattagtttatatgcaccagtgaactaagccacggtcccactcattttcagacataagagcataattcttattgtgataagttggcatcagtgtaaatagcgtatacattattccatttttcctacatccaaagggatatcgttatgatagagggattctaatttatattacgtaaaaattagataaatcgggtcacttgtataatacttcaccattctgcctttgtttgaggttatttgaatgaacgccacttgttttatcttcaaacttaaagatttttaaagacagaaagagcatctcaatcatattgttcatccccaaaagtacctaacactgcttcagtaaaatttggttcagttgaattcacttgatcattcagcatattaatgtgatgacttttgtatttgagagacagacatggtttaaaagtacaaagaaccccagttgcacctctccttacctcaggagctggggtatatcaatctctctaagccttggtttctcattaataaaaatgcaataacattctttgtccagcccatctcttggtgtcactgggtgggtcaaatgaggtaaatctctaaaatacctttgtaagatattattattctttgttatgtgtgtctctgcagtgcggcatatccaaaatattttttgttttcaggttctttgtgacaatattaattttttcctatatttatccccagtgaatctttgctttgtttgtgaagtcatatcctccaagtactaccttacagcattctcactgtttccattccatgcatgctaaatttggtcacttctctagtggtgtccttctagcagaagaaggatttgaggcttcctctttatataattacttatttcagatatgaaacaaggtcagagagaaagtagagccatctcatacatcttctgcagaggcctttagcattcagtaatccaaggtcatcagcaagaaggaagagaaatggggtaggggacttgggtgggttccctgcctccctcacacgattattttgtaaatggatgtaaaagtaccctgtaaactgcatagctagagcagctggagagatttcttcctgggctggatttaatcagtgcgtctttgtttgaagagtggagagttttagacctctggcatacccatatgcaaatgtgaatgcaaatttcaaaacctaaaagaacttgtatttggattagaaaccatttggaattatcaacaacatagaaaacatgaaaattgtacctacacatgttctaaatcaaagccttacttcagaattttggcttaaagtaatagataattatatgattgaaaaaaccatggaaatgaatcatttaatagaagaactggtcttcctgaactatttgataaatgtcaactacctcaagatctaattaatgcacatcagcaatataataagtatacggtccaagatagtatggatacccatcaaagaatagcataaccctgctctcaagtaaatacaatcctgtcaggcctccagtaatttaactaaaataaaattaggaaaggcagaaaaatatttaaggctgcttctccttcctcatttttccatgggataaaaccgaagattaaaattgtatattatcttaataactgctttatttatttatttatttaatttatttatttatttattttgagatggagtgtcactctgtcacccaggctggagtgcagtggcacaatcttggctcactgcaacctctgcctcccgggttcaagtgattaccctacttcagcctcccaaatagctgggattacaggtgcccaccaccacactcggctaatttttgtattttcagtagagacggggtttcaccgtgttgaccaggctggtctcgaactcctgacctcaagtgatccgcccgccttcacctcccaaagtgctgggattacaggcgtaagccactgcgcctggccataactgttttaattagcatttattgagcacgagttaataggaaggatcagattaccaaatcagactcacatgagccacagagtctccccaacaacatgctttactaataacttcaaggatataagcactcaaaaggcctaggtgaagcagggagaggttcaggacacagcaaataggctttgcttcccagccccttccaccccacattagagatgcactcactggcttgtggtcaaagatgaggtcttcaactcaggtatgcagtcacttcatatagcagggaatattttaggttatgaaacatctccatttacagccagatgggtacatagcttacacgacattttccgggagccatgctccttaaatccacggaccctagatgtgtttaccgcaagcaattctcaaccagagatatcctgccaaaagcagtccatagaaatgaattcctctcgtaaacaccatcagtttattcaccaggagatcatttattagcatgtttataaggagatcaggccaggtcacctgtctctttgttttcccatgaatgtttccccagtaatgagagacaaatgaaatgcagaccagctgctgaactcctttgttcccagaacattcatcatgtcccaagtataactcttaaattctttacatgtgttacttcacgtaatcctctcaactctgtaaggtagataccatcattcccttttccaaatgaagaaattcaggcatgaaaagtttatgcaacttgctgcaagtcacacagctagaaagtggcaaaacaaggatttcagtcctagcatgttgacttcagactctgtgttctaaggcacgatatagctcgtttctgtaattatagatatttctgtgctctttcttttgagacttacactacacacttaagaaagacaaagcttctataagtgagttttgatatcttcaactgtgattaattaaaagggataaaaattattttctattcctcccattgagagatgggacctatttccccatcccttgaatccgggcaggcctctgcctgttttcccaaatagctaaaatagtggaaatgacactgtgcccagcctttaggagacttgggtccttggtaccctgagtcaccatggagaaagtttgattactgtgatggagagaacatttagagatgcactgagaaaaaagggaaagtgatctacctgagcccatgtctgcaaccatccctgccaaggggctagacatgagtgaagttgtcttgaaccctccagaccaaactagctatcagctgaatatcattgagcgacctcaatcaacaacacaaggagaagacgaatcacctagttaaagcctgactgaattcctgacccacaaaatcatgaaaaaagaggcactgcctcccattctccacgatgcaccttgatcatggaaaaggaatccccagaatagtagaaaaatgttttgccaaaagaaaaaaaaaaagagagaaaagaaagaaaaggaggcctctccctgttttccaaaccaactttttcaaatcttgtgtttttttaaataacaaaagtagaactgacaaactgtattaataaattatatgctcttgtcttaaaagttaagagcattccaaagcccaagagtcaggaaagttagttcataggtgagtttgcaagagtccaaagcacaagcaacgagcgtgggtgaaaattttgagagggtcacacgtttgtgttttcaaaggaaaaccatgttggtggtttaaattacaccaaaaaatatataaattggtgcatataggttaatattaaccacatctacactgtgctaagtttctcaagatgaaaatatgtccatatttctctgggtaggagctgtagctattgcctcaaggctcatgaacctatttgcctgtctcatgcctaagcccccataaccttccaattatggatggagaatttaatatatttaatgtaagtcctaactctgcacaaccccacagcacaaatctcacccctactctaagattttttcccttttgtatgcttgaccttcttatctcatcttctctacctctaacactctgtagcacatgtacacacattggcggggcaagaaaagcaataacgatggtagcaagggaggcaggatcattcgttaaggcctgcttctactgttagagctatcacacattctatcagaatgttaagtcactaagcatttagatctgttatttgccaaagctcttaaaaactgcactgtaagatgtcatatatattaaagataaatctggcccacttaagtacgaaaatcaagtactttggccatcaagttgaacattaacacaataaaccacgaacattttataaatgcaactttctaggtaaattacctcatcatttattcatctgatatttattgaacgagtgtgcattttcatgttgcctgactgggcaatgtcattcttatctgatatattgctcacaatagccccgggagttaggcatcattttacccatttgccagatgaggaaacacaagctccaagagagtcaatgacttagacaagactacacaaatatcttcaagcagcaataaggaacatggctcttttttattgtctttgtccatttgtgctgctataataaaagatttgagactgggtaatttataagaacagaaatttatttctcacagttctagaggctaaaattccaagatcaaggtgcccagcaggtttggtgcctggtgggtacttggtctctacttccaagatagctccttcttgctgcatcctccagaggggatgtgtcttcccattgtagaagggcaaaaaaagcaaaaggaagggaagtagctccctcatacctctttcataagggtgctaatcccattcatgagagctctgcccttataacttaatcacctcctaaagccaatgtaattaaatcacattggtaattaagttttaatacatgaatttgggggggccacatttagaccatagcatttacattcacagtctttttaatattcccaaactgcagccaagttctagctagagatttgttcctcataactgcaaaagattcatgttactcacagaaaaaggaaaaccagttgtagcaactttatataattttatgaacataacaaagccacattacatacaagaactaggccctctgacaactatagtgttaattttccaagatgggaaaaacatcagtaggaaaggcaaccattgattgtctctaaattctataacgcatatcacaaaataagctctgtaatgagatgctattttacagcggcctaggaaaagtgtccgtggcagaagctattgatgtctcaactatcactcctcagcctacctcagaagtcacttacggccttgtggatagtttctgtgtatgcaaaaagcttccgacagcaagcagctatgttactcagtccaaataatttttctggccccatggtatgctccacactttgtgaggcaggcctgaaagaccaaggagttaacactccaaagagcaactcttaatcaatgtgcgagaggaggtagtgaataaataccttaccttcctattctccagtgaggcaattccagtatgtgttccaaacagattttaaaaggttcctggtgagattgagcccgttacacacagcggtaacctgctcactaacataccttttagtggctcttctcccttctttgttttacttccccaaacccttgccgaacttcctgagatcatctcccatgtaaactactggtaccctccaacaaagtgtatttttcaaagacagctacaccgatatatcccattccatgtgctcttcttacaatgtgacattggtactttttcatagagaggtagggtgtttattttttccgtttcaatctgcgttggcctgtgactgtggcggaagaaacatacgttattgataaagctagatcataagcaggcagtacagctcccatctggcttttttgagaggctcactcttggaacccagctactctgctatgaggaagccaaacagctacacagaaaggccagatgtaggtgctccagaccacaaccccagctaagatcccagctggcttccaggatcaatgtcaaacatgtgattaagtcttcaaatgattcttgtcccagctataagcagagcagagacaagatgtccccattgggccatgcctaaattgcagatttgtgatgaaaataaatgctgtcattgttttaagacattagatgttgaagtggttcattacttagccatagataatcagaacatacccaaattctcatcttagggtctgctttgggaagaaccccaaactaacagtataaaaggtcattcaacgactcaatggcagtaagttaaatgtgaacccaaactgcctactcagagcccatgccatgtccactacaccccactgactgctcattcagtcaaggagctatttgctctcctaaatatagaggcctcaatgtctctaaggaagaaggcatgagggcattgtactcctcacaattcttgttatataatagatactaaatctgaatacaaaacagtcctgaatgattgtgcctcaatttttttcactgttcttaactctgacatcctaaatcctacccattattctgggtacttttgccagtttcaacccgggaaaaaaacttaaaggacattattgcaaaggagaagagcaatataaatagctaattataggttttgataggtttcgcttttcatcagagtattctcagctgagcagtaagatctaggcacagtttcaacaaattacagattttaaaaaagtgaatagtgattcatctagatttctttccaatgtagagtttgggttaactttgctaacaaaagggtatagatctggaaacacagactgtattttcttaaggaatttttacccaatagatttgtcttcttaagaggagtagattactaaaattaatctgtaaggataaaattcagaatctgatccaaaatataattgtgattcgcactactaaaaccaaattaaaaggcaattccaatattgttactccctaaaaatattacccaccacattaaatccactgcagcacattcaaacaaagacctgataaattagcacatgaaaagaataaatctttacttctctaaagttctcagtagtattatgaacacagtactattgttacttaccagaggttaacaacaagaacatcaatttcaaaggtacagaacaactctatcaaacctttcaatctgtcactgcgactttctttgtaaaatatgctgctgcagctatttcagtggatatatttaacctaactgaatttcttttgataaaatttatttactgaaataagatctctgttttaactccatcactcaacctttggcatctacttcatccatgattaatttaagagccagctggcattttccttaatgctaacatatttgcttaataaaatatatcttaagattggtttctggcccattcttccattttgaaacaaaacaatgatcaataaaatatatcttttgaaaatgttaacggatttcaaccaaatccaattagaggtagagtttgagagatttcactagtgaagtctggtccatttatctatttaacagcagtgataaaaacagtacttctacataaacaggtaattgcaagattcatttattgagcactgaatctcctagaaggtatgataattactaaatgaatccttgctttctgttgggtcacaggtattggtcagaatgttttctgagatggaatcagaatcattaaaatctctttcagttgcatgcaattcctcagctatgcccaagacttctaggactaagaatgcgcccataaaagatgtcttatttttatcgaaaagtcatataaacattttgcattattactcctgtttttctggcttcctgtggaattttaacatacataagacctggtacttttgaatttcttatctgggctatggcagcagagttaagagaaaatattaatagcacctgggaattaaaagcatattagtgatggttatgccctatggttaatgagcacatggtagtcccgcctttccttaattgtaagaaggggtgattggcggggcacggtggctcacacccgtaatcccagcactttgggaggccgaggttggcagatcgcctgaggtcaggagttcgagaccagcctgaccaacatgcagaaaccccgtttctactaaaaatacaaaattagccgggcatggtggtgcatgcctgtaatcccagctactcgggaggctgaggcaggagaattgcttgaacccaggaggcagaggatgtggtgagccaagattgcgccattgcactccagcctgggcaacaacgagcgaaactccatcaacaaaaaaaaaaagggggtgatcagtgatcattgtgcttcttctcctcaaatgttggcaagagttatgtctaagtgatgaagtgctattcaatcctaccacagtataaaagaaattagctgcctgcccccttggaggaccggcatcactacatcctcaacctggaaggatctttgggtcttataatccagtctcctacacagtgccagaatctccctcctacatctatcccaacaagaagaaaatttctgctgcaaaaatcttttaatttctagacctacctgtagtcctcagggtattagcaactagccaatacagaggaggagacctcctcaagcttgtatttgctttgagcaagaagcaataggcaaaggagagaaccaaatactgaaactcttgccctatctccctcctcctctgggtttagctttatgatatcttttcaggaatgatatattttccatcacccagcataggccctggtaaataataggtgttcaatatattttgaatgttgaataggtaaaacaaagaccttttgccactccaaatatcccttcatactctctttaatatttgaaactctttaataggagacaaaggctaaactataaataacacatgagaactaagagttcaaatgaacatggaaatcaagagtttacttttttaagataattcatttcccgtaactccaaaaacagatatcgcgtactttattctgtttaataatggggcaagggttggagcacagagaaggaactagttaaacggatacattttactaaacgtatccttttatttaattataatgctgttcagaataatttgaggtgggattcttttagaatacacttgggtttttgttggtcctaagaaaagatgagaggagaagcacaataagacagaattacaaggcagaataaaaaatgatagcgcacaggaattagtttgccagaaagtaacaccaccttccttcaagactaatactgtgctacactcctggaaacctatttccaggagaaatagagagggtaagtgccaaaatatggatctagcgtagaatttacaacagaacactctgcaatatctctggaaacacagagagatcaactcaatgtctaagggctagaagcagttctcagctgagaccccttggcaagaagaatccctctctactcctctccattgttcttccttctttactcacacttcctttctcccacatcaatcaatgtcaaatacatttctttcccttttacccatgtccataatgtttggaataacatttctgtggtgccaattgtaatcccaaaagacacaatcccaaacatcaaaatccccaaagatcaaaattcctaaagtgtaaaatccccataatcacaatcctaaaagattaaatttccaaatgttgaaatcctgaaagtaaaattctggagaagggattcgtgcattttcagttgtacgtaggatacctgcatcgtgttagttgcatcatgttaaatggaactatcaccttgttattatcttcattcgtaaattaagtatggtttaggaaaatgtgtatgggtgccaagtggacaattttaggtgtcaagttgacaattttaggtgtcaacttgactggattaaggaacacctagaaatgtggcaaagcattattttaggcgtgggtgtcaaggtgtttacagaggagattaatgtgtgagtctaagtggactaggtagggaaaatctgccctcagtgtgagcaggtaccatccaatcagctgggggcccagagagaacaaatactgagaggaaactgatttctctgagagctggaacagatttttcttttgctgccttggacatcagaactacaggcttgctggcttttggacttcaggactcacaccagcagtctctctgggtcctgaggcttttggacttggactatgagttataccattggcatccctgcttgtgaggcctttggacttaaacacagccatgctaccaacatcccagggtctccagctttcacatgacctgtcgtggaacttctcagcctccataatcacatgaacaaacggccctaataaatctcctctctcatacatacatatacatatatatatgaattcatacatacatatacatatatatgaattcatacatatatgtatatatatgaatatgtcctattggttctgtctctctggagaaccctaacacaaatttggtattggggaagctgaatatcatttcttcttactgtgtttcttgaaacacactggaagagatctgtgaaattgttccctgatgaaaatgctgcaataagtgtatgacgctacttaatggtgaaagataaaagtttaaaagctaattattattgctgtcgcaaaagcagaaagtcacttaattgtaaaggccaagcaatgaccagactttcaaatgaagagcattaagttacaaaatttgtagaccacaaccactctccagatacaagtgccacaagtgttttgacgatcacagatgaagtggaaatgcaggtgaaaaacaagaactctcccgtcccaaattatttgatcatgtatgacttctgcccctttacacttggcattgattcactatgctatgtatttcatctttgcatcatttctgacactggaggcccgcattttgtaaatattttagataactctaatgaattgtatgcttttttttttttttgcagatttgactctgcagaagtgcaatatcacaatgttgactttctgtgtaagcactgtgcatgctgaaattttctcattaaataaagagatgtcctttgtatacacctgcatttgtgaaaagtaaaacatctcaagatctcagctctttgagtgactacatatgcagtgatagctcattgtgggttttcatcaatcctttcaaaagacacaggttgttaatcacggtatttctgatgactggttataaagcctggtgcatacaattaccaatcacaatgatatttatttatacattttgctttttaacctgttatgaatatagttcatctgctcataatggctatacccatgcaactgttattaatatacctgagtgttcatacttgcagaaatatgtaggcaattattgcctattttgctatataaagtagcctatgaagtaccctgttgtgtttttatgtttctcaatctcctttttaaaatataaataaatgtcttttaaataattttttaaaattattttttccagaattatgtttttgggatttagaacttttgagatttcaacattcaggattatggcacttgagattgtgtctttcacgacagtggcccaaacccctgttcccaatacacaacttagatgccctcgtgaaaacaagagttttccatattagcgtcatgctccatcttttttcatccaacctctcaaatatcagtgctatatcagatcaaacaagtattcactccagcccctgggatgtagtgactggtactctacccctgtttagaagtcattagctctttcatgccaattattactcacagatcctgatgaacttcaatctcagcttacttcttccctgaaccccaaagtactgttgtgacatgcatactctatgcaagcattcagaaagattaaataaattttcataaaacttatcttaaaatctataaagaaaatattaattgaataagcattgccagagacatgaagcgccattagagaaaataaagtaatagccattagttccccacaaatcttttataggatggaagatatctgtttggttaggtttaagcttagtatacccagtggcaaagagggtttgacaaactcagaagttcattggtaatttcttacttaagtagatctggtttccatattttaaagtggaaaacatgagcatgtcaaaatcaaatatgaaaaactcaaaggtattggctgtagttgatcatcttccaaaggtataaagacatgtttcctctgaattttcaaataaaaaaaatttctagtttaaattagttccttccaacctcacctcatctaacaaccttttcctcctaacaagtagctttagaataacaataattcaatattttcccatctagttattcattactatgctattacaagtaagagctgggttattgaaaacgttgtttgtatttcataacatagatacatgacagactggtttatgcatcattttttatctgtatgtcattagtcattttgtccattttgttttagggtggttaacgttgtgggggttctctacgtccttcacatcttaaattaaagcagtcttttgttcagtctgtataaatatgttatgcttgttggacaatgttcagaaaatatgagttaaaaaataagtttaaaatacatgtaatacaggagaaaacataggggaaaaggttcttgacataggtctgcacaataattttttggttatgataccaaaagcacaggcaacaaaggcaaaaacagacaaatgggactacatcaaactaaaaagcttctccacagcaaacaaaataatcaacagagtgaaaatctacctacagaatgggagcaaatatttgtaaaccatatatctgatgaagggttaatatccaaaaaatataggaattcatgcaactcactagcaaacccacaaatagctcaattaaaaaataggcaaagtggtgtactctcagtcataacagtaaataaattaagctttgaaaaaaaataggcaaaggacctcagtagacatctctcaaaagaagacatacaaatggctaacgggtatatgaaaaaatgcaaatcaaaaccacagtgagatctcacctcacactggttagcatctatcaccagaaagataaaacataacaagtgttggggagaatgtggaggaaagagaatatggttggtttgaaacataaattggtacagaggttccccttaaaaaattaaaaatagacatacctcatgatccaacaattccactactaggtaaaaatgaaaacattatctcaaaaagacatttgcactcccacattcatttcagcaatattcacaatagccaagatacagaaacagactaaatggattttaaaaaatgagagatgcacacacacacacattcccacaatgaaatattattcagccttaaaagataaggaaatgctaccatttacaacaacatggatgaacctagaggacattaaaccagatgcagatatggtctcgcttatatatagaatctaaaaatatcaaattcatagaaacaggagtccaatggtcattaccaggggttgaaaggagggagatacggggaaatgttggcaaggaggtacaaagtttcaactatacaagaaaaaaaagtaagttctggagatctaatgtgcaatgatgagactatagttaacaaaacagtatctgtctcttcttttttttttttttttttttttttttgagatagagtctcactctgtcacccaggctggagtgcaatggcgcaatcgtgacttactgcaacctccgcctcctgggttcaaatgattctcctgcctcagcctcccgagtagctgggtctacaggcacccgccatcatgcccagctaatttttgtattttgtaaaaaaaataacagcttatgattcaggtgatccaccagcctcggcctcccaaagtgctgggattacaggcgtgagccaccgcgcctggtcacaatacagtatttcatacttgaaatttgctaagagggtagtagaacttaagtgttttcaccacacttgaaaaaaatggtaactctgtgaggtgatatacacgttaattagtttgttggtggtgaatatttcacaatgtatgtatatatcaaatcaatcaaatttacacctcaaatatatgtaatttttaattctcaactatatctcaataaacttgggaaaaacatcttgcaagctggccctaaattgtggaaagtactgaatccatgctcttaaactatagtgtccaaccttttgtgatcagacatgctatttattcattcacttattgaatagtaggtatttattgaatatttactatgtgctaggcatgcttctagactatggatcagcaaactttttctgtaaggggccagagagtaaatattttcactttttcaggccataggctcccttccacacctcctcaactgtgcctttataatgtgaacacagcagctacagacaatacacaaatgaataagtgtggctatattccaacaaaatgttatgtgtgaaaaaatgagtcagcccagatttgaactgtgggtagtagtctgacaacctttggtcttgactcttaagatattcagtgaacaaaacagacaaaaatccctttcctcatggaagttacattctaaaaaaaaaaatctgtaaaaacattagcatttatctccaaaatatgtatatgaatttatttttaagatatatctgcattaatggcatgtaagtacattgtgttgtatacatcattaaatgtacccaatattataaattacaagcaataagataaaaatattttaaatatttttaatactttattcacttttttcactaaaattataactatctttatattttagtgagaacaatgtgattgaataatgctttataactttcaataagtgtcaatattttttaaattgtggtttaacagcttatgattcaaatctataccagttattttagatatttggttttggtggctgtcatggtagaaaattcacctcgcaaaaatatatagctccaaatggaagaattgaatttttggctgtgcttattaaaacatgattatcatttttaaatctcaattgccaattatgcaaagagtttcattaaatttttggcttgtacatttacatcttcctcattgtaaatgggttgttactaacaactaattggaaggtaaataaacatttgttgacttactgaataaatgaataaaaattcattgaaaccatttgaaagatttttaaagatgtttccaagttgataaagtatgttaatgagagtcaggctgaggcgggcggatcacgacttcaggagatcaagaccatcctggctaacacggtgaaaccccgtctctactaaaaatacaaaaaagaattagccgggcgtggtggcgggcgcctgtagtcccagctactcgggaggctgaggcaggagaatggtgtgaacccgggaggcagagcttgcagtgagctcagatcacgccactgggcaacagagtgagactccatctcaaaaaaaaaaaaaaaagaaaaaagaaatatatgacatacttacatggttttaaccaacaaactatcatcactaaaatttaaggcacataaatataccaactaacagtacgttgggggatggaaagagtgatgagaccattgtcaaagtcttcatgcagtagaatactcacagttccccaaaggaagttctcctaagtaatgtagcacatgacttagcacattcagcaagcagaagaggagagaagttcaaagtcaatccttatgtttaatatcagtattttttctttcttttttcattcttccttcttttttctccttccctccttccttctttccttcctcccttcctccctccctcccttccttccttccctttcctttttaaatatagggttaaatatactccatgcatcacgtcttacacactttggggctcactttgaagaaaactactcttgagagctatttattttgtgtgtattttgcattcaaagagtgccctttccaacactattttctatttgtataggatttcaacctgtattgttagatgtaactgagagattctgccagtctggttcaccttctctgtgtgcgtattttggagagtaacaatttcccatcacggcacacttgccgtaagaatgcagagaaaactcagattcgatgaatctctttcattcacacctaactcaagcacaaccatctctctgggtagctatttttgctttctaacttctatgtctgctcctctccggaagttaagcatcattaaactttaactatctgaactgtttggcagaatctccaaaacttcagatgaactttagccaagttttctgtgtccctaatgagaggttattaatcaatagtatgtttgtagtcatgaaagggctgtttagaattttaataaatgtcatctagaaaattaacaaaaaagtaattaagaagatttattacctgattccctatcaccttcatggtcaaaccaaaggaaagtgcgataaagaatgaggattactaaaacccgaacacttttataaatatgttctcagaaacatccccaaatagccagaaagctcagcactggtctttccctgctcaggtgatattctacagcatttttcacaatgttaggtaattagttgtttatttctccaaccactcccccaactctggaaggaattttagcatagggaattttattcgttttcttttttgtgtcctctaacacacagcagtgttctcttagcatttgctgaaattaaatagaatattgtggaagttcccaaggccattttaaatcttcttgaaccacaattgaagaaaacctcaaaatatttaacttcatcttgtgttcctgaaaaatagatggaaaatacttccttctttgtgtagttgttttaatttaggaaaacccttgtgtaaatatcatcatgccttgtagcaccgagcattcttcatgaagtgtatttcaaatacatggagtttaaaatatgaaattagtttgacctcgccttcttataaaaggaatagttcaaactgtcattatttgcagatgacatgatcaaccacaccaaaaaatctaccaaaatcacagacaaacccagaactaataagaaagttcagtgaggttactagatacatcaacttttaaaacaaacagcattcttctgtatcaagaacaaccaactagaaaatataaacatataccattaacgagagcatcaagttctataaaatatctagaaattaacttcattcaaaatacacgagactgctatagaaaatttttaattcaatgaaagaacacaaaagaaaaacaataaatgagaatttcatacttttgaaaggatgacttaatattttaaatatgttgattttccccaaattgatctataaattcaatgcaattctaataaatattccagcgggatttattttgatgaacttgataaacttcttctaaaatttgcctagaagtctaaagctctacaaatagctaagttgactttgaaaaagaagatcataaagtaagaaactgctttatcaggtattaaaacatattaaaagtcataataaaaaagacagaatggtcttggtgtaagaatgaacaagaacaccagtggagcagaaggatgaatcataatagaactatgtaggactatgtccctaatatacaataaagatggcaccatacacaaatcaaaaaatgaatcatttagtgtacagtgtgggaaaatcctttttgacaaaaattaaactgaatttctatataacatctcacaaaagttggactccaagtggattaaagacctaaatataaaaagtaaaattaaaaagtaataaaagataatgtaagagaatagtttcataaccctgagataggcaaagattttaaacccaaaaatcatgatctataaggtgaaacgcaaatgagtattattatagcaaaatgaaggattttgttcaacgactaaatcaaacagatgacagaacaggacaagtaatttgaaaagtctaaaactgacagggaactaatatttggaatataaaaggaacacctacataatagggacccgtgacaaaatgagccaaggaaatgaacagtcaattaagtcaagaagaaaccctcgcatattaagagatgctcaaactcactagtaattagagaaatgtaccactttaatgtatcacacttttaatgtatcagattagcaaaaattggaaaactggaattcctgttactattgctacaaaacaaactaccacaaaacttagttgtctaaaacagcaacaatcatcttattatttctcacggtctctatggaatagagattcattaagggcttggctgggaagttctggcccaacatcagatgtccggaactagaaaggctggagttgaccaggcatctcccctcacgtagccttctccttggggtccatcacataggctactttgggattcctcataagcgtggttgactcaagaaagtcagtcctcttacatggtagctcaggaccccagggcaagtgttccagcaggcaaggtgaaatctgtatcatctcttaggatctggcttcgaaactcacacagtgttactttgccatgttcctttggctgaaacagtcacaaaaggctgcccacattcaagaggaggagaattggactccactttttgatggtgaatggcaagtttcttagaagaacaagtgggatggaagattgcagctatctttggaaaaatgtaatctgccacagctagataattccaagtatttgagggcatgtggtaagatagagtagagataggaacagatattctggaaagcaatctggaagtgcttagataaattaagtgaatctaaataatttgatccagacctctcattcctggatatatattcctgaaaatttttctcaaagtctgtaagaggacgtgtacaaggatgtttatcacaatactctttgaggtagcagggagttggaaataatctatgtttcatcaccaggggaatgagtaactacaacgtgatgaatgcatactatggattactatgcagcagtttgaaactataggataggtgtatacacagtataaaaattatggtgctggccgggcatggtggctcacgcctgtaatcccagcacttcgggaggctgaggcaggtggatcacaaggtcaggaaatcgagaccatcctggctaacacagtgaaaccccgtttctactaaaaatacaaaaaattagctgggcgtggtggcgggcgcctgtagttccagctactcgggaggctgaggcaggagaatggtgtgaacctgggaggcggagcttgcagtgagctgagactgtgccactgcactccagcctgggctacagagcgagactctgtctcaaacaaacaaacaaaaaaaattatggtgctggaaaataaagagaatgagatttatagtacaatactactaggatttctgtttactaaaaattcatgcacacacaatacatatatttcaagagcacatagaaatgaagggtagacttcaacccattaaatgtttacctatgggcagaaagaagattgggagtaaggactagggagaaaaaaacagaagaaaaattaaacaaaacaataaagaaaacaaacagggacactgtgttggccaatggtgtaccttgaactaaggaggataattaaccctgtcctttgcattgatttaataataatcttcaaaggcatagcaagaccaattgtataaggcaggcgtctagttcaaaacccagaaacatagaatgaaactttggtctagttacaaatatttctgtaactcactttattaatctttcaacatataatctgaaatatagtcaatattttgggaccaatgagaaagaatttttcaggcagaaaagcttttctagaagtcttaaatttacacatcacatgagtctcactttaatcaggattagaacatgtgtactttaaaaaatatacattaacaatatgaagattcctatatatttggtgcttagaaaaaaaaggaaatttttaaaataacctctaaagtaaattaaacagacactttcaaaacaacaatacacattctgcaataaaaagacattaaaatggctgcctatggggcaatgagggtgaaatatgtgcataaaagaaaaataatttcttcttttttgtttcttttttgagacagagtcttgctctgttgcccaggctggagtgcagtggcatgatcttggctcactgcaacttctgcctcccgggttcaagcgattcttctgcctcagtctcccgagtagctgagattacaggtgtccgccaccacctcccacctaattttttcggtatttttagtagagacagggtttcaccaagttggccaggctggtcttgaactcctggcctcaagtgatccacctgcctcggcctcccaaagagctgggattacagacataagccaccgcgcccagccaaaaaatgtaatttcttagcacatttagatttttaaaacctacatttaaatttttaaatgagccaacatattgtaccaaaataacatttctaagagaaaatatattaaccactcaattattcctatttatcacaatattttaactctatgatgtctcagggattgaatctgatttaatactataataaaaccacaggtccaatggcagaatgctgggaaatagccaaagactctgtttcatttatctgatgtaactttgacaagtgagttcaatgtcggttgactggcatgtgccttccttttcttggccttctcttttattaatgtagtcacagctgtaaggcttgaggtactgtcacaagagacagagagggctgaagctaaactaaaatgctataagaatattagcgctttggggtgaaacaaatattaagaagtgaactacggccctaggttttcacaccaggatgctttacaaaattaacaaaagggtactttaatctccaacccccagaagacatcctaatgagactggaaaagaaaaacggtcctgcatcccttactctctcccattcggaacctgagaaaaattgaacaatttgtatttaacctctttcacaaggtcaccaacagtcaatttgtttactggttattcaccttcaaggactgtgaaagggaaaggactcaaaaaaacacagaccggagatagccatattcatgcaattctataaccccatggcagcccactgtttccaagcactgatatttgactatttgtgaaggcctcggttgaacacaagcagacggcaagccaggagctccaccttctagtctcaattaaaattgaatttcttgtgagtgacctcacactttgggttatctcctttcaaaagacactaatatttaagtttcctcaaaatagcaaaatattttgaattggtaaaacgcatgaaggagaaaaacatcctttaaaagtttctttaaataaaaaaccaagtttctacaaacttctttttccaatatgaataatcttacctccattctttagcccttaattgaatttaaaaccgtaacatatacattaggttcttctcaaaaggcatcagaaggtaggaaaagtgaaattcagcaacatgcctttttctttaggttggtagcttcaatcagagggggaattccactaataatttcagtaataagacactaatgaatatgtattaactgtagttaagtacttagcttagtgccgaacactcttctaaatacttaaatgtattacctcatttaacccttacaccaaccctattaagattagaagatgtgtactttaaaaaatatactttaacaacatgaagattcctaaatatttggtgcttagaaaaaaagaaatatgtgaaaattttaaaataacctttaaagtaaagtaaaatagacacttgcaaaccaatattacacattccgcaataaaaagacattaaaatggctgcctatgggtcaatgagggtgaagtatgtgcataacagaaaaatgtaatttgttttttttgagatggagtctccctctgtcgcccaggccacagtgcagtggcgtgacaatgctgaggttggtgccaatattattcccattttacaaaaccttagaaactgagagacaagtaacttgcttgagatcacagagctagtaaatggtagaactgggactcaaccctaggcagtccagtagcagaacctgtactcttttttttgaaacggagtctcactctgtcgcccaggctggagtgcagtggcacgatctccactcactgaaacctccacctcccgggttcaagcgattctcctgcctcaccctcccgagtgtcaggcctctgagcccaagctaagccatcatatcccctgtgaactgcgcgtatacatcagatggcctgaagcaactgaagatccacaaaaagaagtgaaaatagccttaactgatgacattccaccattgtgatttgtttctgccccacgctaactgatcaaggtaccttgtaaactcccccatccttaagaaggttcattttcttttatttttttttttttttttttgagacggagtctcgctctgtcgccaaggctggagtgcagtggcacgatctcagctcactgcaagctccgcctcccggattcaaggcattctcctgcctcagcctcccgagtaactgggactacaagcgcccgccaccacaaccggctaatttttatatttttagtagagacggggtttcaccatgttagccaggatagtctcgatctcctgacctcgtgatccacctgcctcggcctcccaaagtgctgggattacaggcgtgagccaccacgcccggccaagaaggttctttgtaatctcccccatccttaagaaggttctttgtaattctccccacccttgagaatgtactttgtgagatccactgcctgcccgcaaaacattgctcctaactccaccgcctatcccaaaacctgtaagaactaatgataatcccaccatcctttgcagactctcttctcgggctcagcccgcctgcacccaggtgaaatacacagccttattgctcacacaaagcctatttggtggtctcctgacacagacgcgcatgacacccagtagctaggattacaggggtgcaccaccacgcccggctaattttttatttttattagagccagggtttcaccatgttggccaggctggtctcgaactcctgacctaaagtgatccacccacctcagcctcccaaagtgctgggattacaggtgtgagccaccacgcctggcgaacctgtaatcttcattataatacaatactaccctattaaaaaagttaccagaagagagactgaagcaattagctaaagcaacttattttttacagtaggctttgactggtcaataatattcttaatgtttccttgccttccgtaactactgtctaaattatgtatcccttttcagagatgctagcagacctcgtctcctgaaagttacttcaaattctcagtatttggtttcttttttttttttttttttttttcagatggactctcactctgttgccagtctggagtgctgtggtgcaatctcagctcactgcaacctccgactccctgattcaagcgattctcctgcctcagcctcccgagtagctgggattacaggcacacaccaccatgcctggctaatttttgtatttttagtagagagggggtttcaccatgttggccagcctggtctcgatctcctgacctcgtgatctgccaacctcggcctcccaaaatgctgggattataggtgtgagccactgcatccagcctggttttctgatctataaagatatgacaggtccaaagtccaaaatgctctggaaactaaaggcatttttaattattattcagccaattcatttgacttgacctaaactcacttagtctcctcaccttattttgtgaagctttctctggagcctcctactctgtcccggcagagccaagtactcctcctcagtgcttctatagcagttcaggtctgactttggctacacaggactgtgtttaagtcaacagtcttgtccacccacctattctcatcctcatctcctcacacttttagttagaagtcacccacaatgctcttctcagagactaaaaataaatgggttcaaattcagagtttacgttatccaaagtacaaaaattgacaagatacgtaataaggcaaaacataatcttaggaaatcccaataaagtatccctggatgcaagggtctacagaaaaaaaaaataacttctgtctctgagactggcactagtctcaacacttaataaggtaataagccggggcatgaaatatctcatgcaggcatatttctacaacctgtatcagatggttgggcaccgatggaaagaatgactgtaatagttaggatttattatgggagaagaattccatggtgaacatgcaagtaattcaggtagttggcagccttttttttaaagaaatattgtttttattatttattttttatttattttttgagatggagtcttgctctgtcacccaggctggggtgcagtggcgcgatcttggctcactgcaagctccgcctcccgggttcaccattctccggcctcagcctcccgagtagctgggactacagtcacccaccaccacgcctggctaattttttttttgtatttttagtagagacggggtttcactgtgttagccaggatggtctccatctcctgacctcgtaatccgcccacctcggcctcccgaagtgctgggattacaggtgtgagccactgaacccagctgtttttattttcttaagaaaaaaaaatgaaaatttctgatagttgtctttattaactaaaagaaagtaaaaaacatcacagattggttatagtttcatatatggactatatgacatttaaagtcttttttttttgaaatgcagtaactttagaatggcaatttattttacaacccatacgttttgctaattaagacatgatggtttcaacaaaagaaagtataaaaacataatatagattgcttatagtttcatatgtggactatagaacatttgaaatctttcttttttcctgaaatacagtaatcttagaaggccaatttgttttacaacccataggttttgctaattaagatatggtggtttcaggcagggcacggtggctcatgcctgtaatcccagcattctgagaggctgaggcggtcggataacttgaggtcaggagttcgaggtcagcctggacaacatggcgaaacccggtctctactaaaaatacaaaaatcagccaggtgtggtggcacgtgcctgtaatctcagctactcaggagactgaggcaggagaatcatttgaacctgggaggcagaggtgcagtgagccaagattgcaccactgcactccagcccaggcgacagagtaagactacatctcaaaaaaaaaaaaaaaaaaaaaaagatatggaggttgaggtttcagtttgcagatgtcagcatgaagaggagaaaccatcaggttttcaaactgtgagcttattgtggtgctcaatgcccttttatttttaaagagagagacaatccaatttgctttttgttttttcagtaggactttggctaataagtaatgtctgttcataaacaaatgccatgtaatgcgaacagcataaattgtatagttttaaaaggcctttcaaggggatgaacactgaatttttttctgcaagacacaaaataacacaggcagtcaggtttaccttaaagaagacttatcctaagtcagcctcatacgaaacggcaaatctataaggtatggcagcatattaaatcaatccttttaataatgtttcattaaattataacatgccatccaggggatcattgcattttgaaatttggttgttttcctatgagaaacaaatagaaataaatcagacaaatccccttaatgtattcagagattctaattcagagttctcccttctttgttatgataacattactttgatgtcacattttcctaagcaaatatagcagatatctaactgaaatagtgattttattgattactaggcttacctatcttgaataagtcacctcataaagtctttttttctccttagtccccttagctgcttctttcacagtggggaaaaacagtctttgtaatagaacgccagtttgcagatgccttgtttatatctttacgtacattgtttgtttatcatttatgtcatagttccactaccaccattttcttatttctgccacgatatagactctcatctctggtcacacttcaatgtgtcatatgggtgacataaagctgaagtggctcagtttatagaccacgaaattttgatgacagttaagttaattttgcatgaagatcaaggagccgaagctgcaaaagtcattcatagaaaacgactttgcaagtggaaggttactgtctagtttaactgggcccagctctctgcctgagattatttcaaattgcattattcacagcacaccacctgtttgtaacactgttttcctttccaaaagctttatagtttaaaacaacagtttctgtatgatttattcatttatttgttcattgaaaatataacacccttctttaaaataaagtttggatctaactagataattaagcaggtgaaaatctgggatttttctttaaaccatgataaaattttgttttccaaacacccacaggctcatgaatttctgaagggctctgtgtaaataagtctaacagaaccagttagcaattccagcacaatggctctcaagatgcagtcaaattacagtgattcattcatttattcattgacaaaaatactggaatacaatggtaagcaaaagaaacagtctgtacctttggggaggcactagcctggtagagaggaaatttttcatcaatcacataagtttaaaaaatattgtatttgctgcataacaaactacctcaaaacctagtcacttacaaagaagcatttattgatttacagtttctatgggtgaggaatttgggaatgacttaactgggtggtcctgattcaaggtctctcatgaggttggggtcaagatgttagtcaaggctatagtcatttattaggttgacagaaattctggtttgcctgaaacaagcctggttatgccccctttcctggcataattataattagcattccctttcatttttaaaagtgtcctggattgtacagtacattcatcactgaactaattaagaagctatatccagaatagactgctcccaatatgaaaaaatatctggtgtttcaattccatagtctctcacccctccctacgcctcatgcatacatagtggctttccttcctatttgcttccaagttatctcatcttcccatcgattctgagagcatccaatatagatctaataaatttccatttgcttaagctagcccaaatcaagttctgttgcttgcaaccatagactcctacactaatacagctatgataaggcgatttcgttctatactaatagcaatgtaaacttatggaaaggttttaagtgtatttgggtagagggagaaattagatgttcatttcaacaccattagttgttacagagcagagaaaaattagtgatgagaatgggaactagaaagcaaattaggaggtattgcaatagtccatttgatagtagatgatgctgtacaccaggatatgggttatgaagataggaagatgtgatggattcaagagatctaagaagtaaaacagaaggtagtggaggattagatatagaaggtgaaggagacatagatgttaagaatgattcctatgtctctggcttgtccaggctgtgtgtgttgagtctattagctgcaacagaagatacaagaagagaatcagatatgtgagtttgggatttttttttgaaacattctagaagggaaattaagtagatagttgaatacatatgaggagagcattgaggagcagtctgagctagagagatatttgcatgtcatctgcctacagactatagttaaaaaaaaaaaaaaaaagcatggatttggagcgattacctagaccagaacttcttaaccctggatggacattagaatcaactggggacttgtttttataaaagccgatgcctgggcccagagattctgatttaattgattggggtgtgacccctactttttaaatgcttctccatggtttgaataactatccagggttgagaactaccatagagtgagcatgcagaaggagaaaagaagggacaagactgaaccttgaaaaacttcaacatctactggccacttaggagaagacaagctgtcaaatgagaaagagaggaagcagccagagaggtagggatatgacaaataacaggagatattaacatgaaaccaaaacatgagtgtttcaacagggagagaacaaacggtcaattttggcaaatgactaatgagaagtaaactcagattagaactaagaactgttcatcatatttaggaacactgttacctttatggaaagatatttcagttttctgataagacttaaagctggacagaagtgggctgggcagtaagttgatggtgaaacaatggagatagatggtagagacatctcttagctggagagaacgatggtgtggtagctggacatgggtgagtactcaagttattttgtcttattatatatgatagacctgaattagtttaaaagttgatgcaatgtattcaactttcagaaagaaaaaagtatgcaagaaagggataaatacaaaagagtgtagaggttttgaaaatatgagagatcttaggtgggcatcgtaaaaacaaggggaatcaagccagacagggtggtgcatgcctgtaatcccagctacttagaaagctgaggcagaagaatcgcttgagccctcagaagttcgagacgatcctgggcaacacagtgggaccccatcttttatctaaaaaataaaacagggaaggctcaatcttaaataaggagaacatcttctccatgaatttaggagggaagagaagtatgtaagagcaaagccagtcgctatattttgaactagaaagataagaaagttccaatctgattttgttttgttttgttttgtttttctgtaaagtagaagggaaggtatgagttaaaaataggataggaaggacatgtgacaggcgaaagtgtagacagagtagcaaactgttggaatggtatttgtgaagagtgtgggagtgagctaatcagagaaggcgagtagaactgccaagcagtatggagagctgttttaagggaagtcatcattaatttacacagaaacaagtgcaagaaccaagttcatccaaaaatgtgctttttttccaggtaacgcgacaaaaagaaaggggacaaggaagttccatatagtaattaaaaacagttatagaaatgatgtgccatggaatctaagttggacgatgagagaaagataaaagaagactgatagattggggaacaatcagaacctctcatagggtcaaagaacagaaaaggtctatatggttattttaggtagatttctaattaacctcagtggtatttcatccaaaatactgatattgaattccatcagtaaaagggctctcttgcattattttgactatggcagtgcgagaggagggtggcgcaaagagtcttcattatctttcatgcaaaattagcggagttttaaatcctttgatcaggaaaagcaaacgagaaaatgaaaagatagaaattacagtcctatagttcaaactaaaaaaattctgaattacacaaactatagaacaaaaaatggcagcagaatatcgtgatgctataagcagccaagtagtccattaatccacccttaaatatgtgtgatactcttatagagctccgagttacaggccttgctttaaaggctggatacagaacctctgatcctgacatgaacactgttcagaatctatccatgaacctggaagtgagagacatcccagggtctgctaccactaaaagaaaataacttacgacatcctcagaacctctaagatcctgaatagctctggagctttttagacagctattttgcctgaatagttaaacccaagtgatataaatgaatctaatgaaaggaaggtcaatcgctgcttgacaaacattttcatacaattttctatgttctagtcataaaactaggctctagagatactatagttggcaaacagaaatgttccctttcctcaaggagcctaacacatatacaaaacagacattaaagaatcaccaatattgaggtgaataattaagccgtgcgaagggctacagtaaaagaggtgtacgtttaatagatatttaggaatatttggaatttagtaatcctggagtagagggaggaggtaatagagaagaattcagcaagaatgcttcaatatggggatgaagcaacttggtggtataggtggcatttattaagatagagaatatagatgaggagccagtttgggacaagaaggtgctgaattgagttttggacatgttacatttgagatgcttgttaaacaaccgagcacaggtatataatagtcagataaaagtctagagctccgaagaaagatttgggtgagaaagatagattttatcctagttggtcctttgctcaaatgggtcccagatctaagcactgctgtgatcaatggccaactgatgaaggcagggcaggtgaaggaggaaaagatgctctttttcagaattcttttcaccacatgccactccagctcaataattatgacagaggcaacaggtacctttgacacatcctccatgcattaccatggtattctttctaaaacacagttaagtttatgacattaccttacctctgatccagtggataaagtccaagcttctaaatatggggttcagaatcttttatcatctagcttcatttcttcctatgctaccccatagtctctagatccccttccatgtaacacatacttttttctacaaacacatcaacgttgatggagtccttttaacagtccatgttggcatttctttctcaaatacgttttgccccctttctctgcctggaaaacttccactcttccttcaaaatcctgcttcatttattccctcattcaataaaaatattttgagcccttcctggatgacacacactctgttagatgtttggcctatggagtcattcacaaaaaagatattacccacccaccccatgttatatacagcatatcagaaaaggacatagataggggatacggtatacttatcagtttctcctcattgggaactggtaaaattcttatctaacatgctcagatatttatatttatatttatattttatttatttatttatttctgctgatacctactggatctctcttttccttgccttgtccaaattctggtgatgttttatcatgaatttttgcctcatgctggtcttcccaggcataacattttcttttatcaaatcatttaatctcattatttgtttttttaattgctcaaagctcactctgatttctatgaaggtttggtgattccaacataagaaataaaatggctgccattatttgcttgagactggcctcttttcctctatttgcaaaaccgcactttctctctctctctctctctctctctctctctctctctctctctctctctgtgtgtgtgtgtgtgtgtgtgtgtgtgtctgtgtgtagtgggtggggtgagtgggtatatctatcttctaagtattctgaatttatcagcttttttttttttttttttttttttttggagacggagtctcgctctgccgcccaggctggagtgccgtggcgcgatctcggctcactgcaagctccacctcccaggttcatgccattctcctgcctcagcctcccaagtagccgggactacaggcgcccgccaccacacccggctaatttttttgtgtgtttttagtacagacggggtttcactgtgttagccaggatggtctcgatctcctgacctcatgatccacctgcctcagcctccccaagtgctaggattacaggtgtgagccaaggtgcccggccctcaccttttattaggattggagataaatgaatttctccattggaccaacatatgagctatgtattaatatacttccatataacatcagtagcccaggattttctgtgtagcctttcaatgctggcaactataacctcatctggtccatcactttctccacctcctagtaacaccagccttgtcagtgtcaattaattcagcatgccatagtccttctatacccccaccccctactccatatattagccacagacactgctctgcttcttggcatcaacaactggaatctggaccacatgttagaggatcttacttcatcataccaaccatgggcaaaagtcagatgcaaagtgaactaacatcaatctgtattttttaggttcttgttatatattaggaaaggttatttgtctcttggtagcttgggaagccctgaatcataaaataaatgaagcacttgatatgtaacaaagatcatattattcatacatattagaattcaaagcctatatgtcatgacatggacttctgggaatttaattatcttaacgttatgtcttcgtgaaggtgtttggaaatgaaattaccacagagctgaacttatacaacttacttatggataggagctcttcttcacagtctagttatgtgagccacttaagaagaaatggcagtgacaggaaaactgtagacaacagaagtaatctgcaaaaggagagagtcacaattttgaaggtcaaatgtggcccttcctaaataagtgagaatatagaaataagaagaagggacatatctggagaaagggatttgtttaaagccaaaagccaagactcttcatgaaactcaaagttgatttccttaagtctctttggttttcaataaaaccaataaccctttattaaaaacaaaaaaggcggattaagtagttagttagcatacatgctattgtgcccaaggccatggtgttaatcccctgaaatgagggtgaatttcattctgtttgaaaactacaccctgcattgagtcagccatcttgaaattacatgtcttcagtgaattaaaaaactggataggactgtttgaataatctaaatccagatcacccctgctgggctagggaaatgctcaaaagtacacactcctcaatacagtgttaataaaagagtaaaatggaaacaaattaaaaagtggtctatacacatagggtagtcattttatgtaagcagtaaaaatgataataattagaagcatatacctgctcaggaaaacgcttattatttcatgctaagtgaaagcaaccacaacaaaaattatatatatgattacaactattttaaaagtatatattctgattaaaaactgaaagagtatctataaatataaaactataggttacagtgttggggaaattataggtagtgttctcaatgttatacattttacaatactattactttgtataaaaataagcaacagcatgccaaaatgatggggcttcaggggcaatatctttatatataatcgtgctttattactgccaagggaagtaatgctgtcattctacttccttctaaactttgttttaattaaaaagagagagtgatcctacacaaatctaagaccaaataaatgtcagctcagcatttgtggaaaatgttaagactagaggccaatgatgaattagcctaattcagagactaataacattaccaagtgaactgtcatcttggttcttacatgcaatgtatgtcaggggagcaaatgtggatagatgcagtggaggatttctacctgtattagcaaaatggctgaagtgttggtgatggtttataatcagaaacctagattttattagctttgactatcaagagtgttcagggaatactaaaatctccctagttcccttcgaactgatggatgcaagctgacagcactgagaatgaggacactaggttctcataggaagacagaaaacaatgggaagatgagcacaaattccaacttttataagatatacttaacgtaacagagtgcacacaactatacatgtgggaaatctatagatgtgataaatcaaactaattgtgtcactctccatgtttaattttggaaaagcatttacaatcctagattagcacccacaaaacttaggctgcacagtgatactgataactaaattttgtagaacacttcatagcattcaaaatgtatttgttcattttatttcacagtgatcggttcatgaaccctttgaggagataaggcaagtgttgttattcacattttacacatgagagaaaaagaatttaaccaactagctgccactcagctagaaagtggcagagtccaaacgtaaattcaaggaatctgactgcaaaccaccaggtcttgctgattcccacaataacattaaagcaattcaaagagaaagctagctttcagtaaaattcatatttaagacacagctttaactctcttctcagctcttttcctacccagagttcctatgctctcagttcctatgcttccctctctgagggaaggaaatttcattcatactaatatgttaggaagatactgactatgccccaaagtttgtttttgcatcaggaatgctaggaaagagcattcttaaaaataatgaaatgaactactggtagattacctagaactgctaaaaacagaggggaaaaaatactctggaagtgttcagatatatacgatcatgtcatttattctacttactcttgaggctgatcctgtacaactctcttaccaattagggatgccagctgtggtaaagtgaaaagaggacacaaaggttgaactatcaaatacaagctgtgtgatctacaataaacaagatcaaataattctgagcctccatttccttgtctgaagaatggaagactttatttacagtgtgggagtgaagataaaatgagataaaacttcaagaaagaagtgatcattattcttaatattttcagctggttgcttttagaggcttttatcctccaaaatcaagttacttcttctatcaatgttgttattctagaagcagcctcataagttttacaatttactgttagcattaaaaagaatgagcaactcatctaatataatgaatgtgttataaaatccatttttagaacttagagaattatctaggaagctcaggaattagcatgacttcaaagtattcaaaacatgggtagatagtttgcattttctaatcacaaggaaggcatctagcatatttacaataacacgtaccaccacctgtacagatagatacatgtagatatgtgtatgtattatacacacatctaacttctaaagcataaatcgatcaagtttattaactctatcccactttcctcagtaataatcatgttgcaacagtccttaaggcacacatctggcaacctgtcttacaatgttaatgttcttcaattttgatggtacgtagtcatgtgtacagtgtagatttcagagccccagggagttcatcttatcatataacttattccctctcatggccagcacaactcttgtagcttggagtaaacattgagtttctaactatgatctacataaaaatgtaaatattccttgtgaatattatcaacttttatcataccttgtccttaacccacataagtttctcagctcttaactaaaagtgatatcctgtaaggatgggatacagataggtacatttgaaacttggagattgagctagctctggaatgttagttcacctgcaacagtgggtgcatatggctattgtgaaagggcagtgatatagtctggatgttcgtcccctcaaaatctcacattgaaatttgatccccattggtttaggaggggcctgttgggaggtgttttggtcatgggggcaaattacttatgaatggcttggtgcctttcttggggtaatgagtgagtttttgctctattagttcactcaagaactaactgttaaagagtctggcacctcctcctgtcttgcttcccctcaccatgtgatactggctccccttctccttccctttatgccatgattggaagctccatgaagccctcacaggcagcaggtgatgtcatgcttcttacatgcagcctgcagaactgtgagccaaaaaaacttgtttctttataagttacccagcctcaggtattattttatagcaatgcagatggactaatacaggcaaccaaagagaggttatcattaaatcaacttggtcccttccctctacatagcttgtgtgccttaggggaagctgactccacccccaggacctcacataggcctggactaagggtaatctactctaccttcttgcaagtgattggttcagaaatgggcatgttactcattaagggccaatgagattttcaatgagacacttttggggagagggtaggttaatttttcttcatttttcaggagagcttttggtagaactctttcttctcttccttgtggatgctgtcatacacaagcgtgagatctggtcagagtaagaagtcaacacttacaaggaagtagagtaaagacaaacatagggaaatggagccagagcaactggacgatacgtccctgaagccccacctcaccactggatttcttcaccagtgtagaaacgtatgccagtacatttcttcaccgtatgggccaggtggtgtcagattttctgtgacttccttcccatgcaggtcagatgatacgaagccaaagacaaatgttgtgctgtgtgggtcccacagccactgtgctctgagcagatattgttttttaaaaaaaatcacaagcatctataccatctgtcacttggtataagtaaaagctagacagaaaaaagacatgtgactttccaaggcattgccgtgcaacggacaaaatctaggttgaaatattcttgtctctcctactctgacagtttcttcccctggattgcattttttcaccattaagatcattgataaactgggaaaatagtctacaaaaatgtcaccttcattttgcagcaatttgaatacataattattcatccatctaagaaaaacaatccattttagaaaattaattattgagtgtataaagtgctttcattcttagaatctataatgtgaattggctggatcataattaacggtttctagcatgattcttataaaggtgtctctccaatcagatctgacagcctacttgcccaccttggctcttatgccttcaagatcttaataaaacagaagtgaacttgaaagttgttccaaataggaatgtgaattaaatatactattcctatctaatatctaatgtctgtatttacccaacattgctaatatcgtaagaggaaaaaaattattatttttaagttgtttttgtccccaaagctatccattaattccttcctaaaagaacagttagaatgtgaatggggacaaccttaatacgactgcattgacaatctccgccctatgcctttttactctattacgtatgtgcagctttatttttgcagtaaaacaatatttttaatgattatattaaatagcattttgaagtcaaactatacagcctaataaattatgagtaatataataaatatgcaggattctatcttggctcacatccaatgggctttaattatgaagctatttaaactaactaattataagacagaatttctgagtagacggcaccctccagccagtatgaactatttgcaaaaggaccacagcaaaatctcaatatatatctacagttcataaaaattattaggtttttaaatttgatataaatgcttgctattaaaatatcacaatccattctcattacctctagatgggatactacctttagatccatctggtggaaattcctgcagataatatagtttctatccctgaaataagctttttggttaacattgccctcgtgagtttatgttaagattctagtgacccaagctgccacctgcttcagtaaggtttggccccaatctattgctacaggttgtatttttccagttgcctgttgcaggtaggggcattatcttccctcagtttaagagacagattctgggctgggagtggtggctcacgtctgtaatcccagcacagaggccaaggcgggcggatcacttgaagtaaggaattcgaaactagcctggtgaacatggtgaaaacccatctcgactaaaaatacaaaaattagccgggcgagattacacgcgcctgtagtcccagctacttagggggatgaggcaggagaatcgcttgaacacgggaggcggaggttgcagtgagccgagatcgtgccactgcactccagcctgggcgacagagcaagaatctgtcgcaaaaaaaaaaaaaaaaaaaaaaaaagagagagagagagagagagagagacagattctggtgctcacaaaggtcaacagaaaagtgtggacacctccaaactggtcttctatatcattaaaatgcaaggaatcaacaacaaataggatatacatatggtcacttgtcaatgacatctttaggccaacaacaaagctattattgttctgaaagaatgtttcacagtaaaaggaacagaaaatcagtaacccttcagctgttaagatttcccatgtagctttcagccttcttccactgtttgcaatactttgcaagcatgctcagatagacacactgactcaaccatgggagtaagctcactagtgggtgaatttgactgataaagttgcaagagaaaacctgagatttaatgcatttgcttttttgtctctgaagccctaaataagtgtctatagacaagggctccactctctattattacagagtttaagcaaaatactcaaggaagaaaatatcaaagttgtttaaaatttatctttttagtatatagataaaggtttatcctccagaaatataaacattaattcctagagtgcaagtttctctgtcccctaattaccaccatcaaaatgacttcgataaaaatactggagtaatggaatcaatttaaaataaaagggattaggagttggatacaaaagaggatctgctgacttagtcagattttaaaacccaaaggtatttcaaagaaagaattttaagataaagctagaaaatttcccatcctgcaagacctaggtcaactactaatataagaattggtaaataaaatagaaggagcttgacacactattcaacaaaaacaagcaaacaaaacacaactttaaaaagagaatgctacctggtatcaagtagaacactgtaagcaccataagattaaactgttaatttagaaagaaaatggcacttgctctttaaaaactgagagggagcagtcaaaaagatttacagagtttgctgaacatataacattcacatttctattgtaagtcctaacttgacacgaaccattagcattaatacaaaaaccaaaaaccaagtgtttttagagccataagacaaaacatattatattctttagacaaatatggtttagaaggaagtgtcttgtgaaagatggcagggacagtaaaaggactcttatttccatttaaaatacaaccacaaaacacatgttttaaaggtaaatgttggacacctgtcacctatatgatacagatgtattcccagttacctgtccacgtgttttatttttaaagcaatccaatggtaccaaaacctattaaaactttggaatccagattgtattagtctattctcatgctgctaataaacacatacctgagactgggtaatttataaaggaaagaggtttaatggactcatagttccacatgtctggggaggcctcacaatcgtggaggaaggtgaatgaggagcaaagtcacatcttacacggcagcaggcaagagagcttgtggaggggaactcccatttatagaaccatcagatcagccgggcgcggcagctcacccctgtaatcccagcactttgggaggccgaggcgggtggatcatgaggtcaggagatcgagaccatcctggctaacatggtgaaaccccgtctctactaaaaaatacaaaaaattagcccggcgtggtggcacgcgcctgtagtcccagctacttgggaggctgaggcaggagaatggtgtgaacccgggaggcggagcttgcagtgagccaagattgcgccactgcactccagcctgggcgacagagcaagactctgtctcaaaaaagaaaaaaaaaaaaccatcagatctcatgagacttactcactaccacaagaagagtatgggggaaaccacctccatgatacagtgatgtccacctggcccagcccttgacacatggggattattacaattcaaggtgagatttgagtggggacacagccaaaccatatcatagatcatatgcccattctcctaaaactgtaaagtgaaagtactttctacctgcctcaagtttggcctgagattagccagtggaaaaagaagagaagagttataaatcactgctctgtcaagtcgaaaagcaagcatgtaaattgctctgagactaaaaaagattcctccctaaggcagaagtaagaatgtttgcttacacctttataaataaagttctgtcaagctgtgagggaaatatactcatatccataggggaagtcagggagccagccttgtgaatctccagtgtaatctatttccacacaatggacattctcaccaccttcctcttgggacagtaaatagtcaataatcatcccagatggtttgaatctaaacttatcagtgacagataataaatcagagcattctgatgtgtgctacgctattatagttccaatgatttcacaccgatgggatattgaaactgctaagtagcataattagttacagataattccaagacattaatcatgcttgggataaatccttggaacaaatattgaaaatattctttatcatatatattaccaaatgcctgaaagggattaatttggtaccaagcttgtaagtatgcaggcatttaaggagcacggcactttttaatacccagaaatgatattccatttgacattttgtaaaatgaagtaccatcccaccatcacttttggcatttctcaagttttgttcaaacaagatatttcatttattcaagggaattttaatctggattttattcatttcaactatttattgaaataatgcaactgcccctttattaaagaatgcaatatccaccccaggaatcattatgaagcaaatgagttttgtttttgcattttttcctggtgcttatttcaaaatcttaactcattttcaggaaataggtcctgtaaggctcccctgggtcctgcaatcgaataccccattcaagtagactttctctggaatcgaactctgatcacttattttccatagtctctcttcaaacttactcctcctgtgtcccgtttactcagaatcaagatcttcaccagctactctcagtaaccaagccatacccaagtatgaataactgagaataacttaattaaagcttatcttccccagtattatagctgcattttaaactgtaaggcttgaaaatgagcagagatcttgggatgtggtatattggtctttggcgatcccataagccatgacatacaagcaaatagcttatgtctagaggtggtaaagaggtaaaaggccaactcagggtatgtgagctaccaatatgagttcttgcaagcattcaaaagcactatatgcaaagaatgtcattaaactcctacatatgtttcctctagatgttccacaaattggttatcatcgaaaactctaaatccagtcttccagattatgtatcccttcatataatttatggtgattctataacttagaatattttcactcttgtgaaattaaatctgttcattcttttcctttaaacttcagtgatttaaataactcttgcaaattctccccctctccataaattaatggaaatattcccttgagttatcttctagtacttttacttttaaaataatatttaaaccttcaatgtatctgaaatttgttgcaactatggcatgagctaaggatttaactttatatttttccaaattggtagctaattgtcctaacaccatgaatttaaaaagccaaccatttgatccaaattactatcaacaggatatagataaagccaattaaaacatatctatatgatggaatactgtgcggtttttttaaagactaaagttgctctctatgaaatgatgccaataatatatagggctgacctacaacaataagaaaagctaactcaatttacccatgtaacacacctgcacatgtagcccctgaacctaaaataaaagtggagggggaaaaaaaggaaagtatgtatattacaaccccattttgttgttgtttttttttttttaactctctctctctctggatatacaactatagacacatttgtataaatattttaaaaattctaaaggcatacaaatcaagctgtttatagctacatctgaggattaggattggggatggagaagggtcttctttttccaactaatgatacttatataatttaaaaaatttatttatagtaagcatacacatatttcacactgtaatgcaagtcttgcaaacagaatcaaatccttgatgttacccaacagtacaattgaaatatacattccaaatcactgaatgcatagaaaaatcagttgctaagacactcctaccctattcctttcttccttcctttgctggaccgtgacatgaacaagaagttaacctttatcgagtttagcctcagagattttggagttattgcagcagttagcctactgtgactaacacaagcctccagtcccttgccaatgactttacagactactgaggaaaatgaactgtgcatatgaaaagttaagagatcagagcagcaatcatatacaacactgctgatagtaagaactgtagggatgaaatgaagaagaaatctccagaagattttcataaatataggatgaagctcatcaaattttgatgacacgaagaagaagtgtaaaagaagtgtgtaagtaaagtgtggaactgggaaaataaacatatcaaataatgggtttcattcgagtagaatctatttattaagaagtagtggagttagtactgaaaatgtaggttagaatctaattacagagaacccgtaatatcagcccaagggtgttgaactttgtcatgcagaaccagtcaaatagatattatttctcatgccagttgctaaggagggctaccagtctcaactagtttgagaacgattctcaagttacactcagtgtcagtaagaaatagcttcctgatcaattaacagtgtctgacatgggctaatgaaggaggcattgttctataccagacatgcgctaactgctagaggcaaggatatttttgagatgtggagaaataagtagacttgatagtgttcttaaaagataaaactgacctaatgttggtgagacaaggaagagtttggaaagacggtacaatagaatgtggtgaggcttgagagaaaggaggaatcaaagacaagcctaaggttttgagctttgactcttagaatattgttaccattttcaaataaagacaattaagaaaacaaagtccatgtcaaaatgtcttgtaaaaagtttgcggtatgaaacagaaaatgcagaatcaagaaaaacggaagcttttttcctttcctctttaagaaggcatgttgccagaagagaaaaaacttatgacttaattacagatcatcccaagtcaacataactgaattccaagaagaatatggcttaacgatccactggatagaataaaagaaagaattgcacattttccctctcaaaaatgatgttttaaagaaccacagttttgcaatgcagtgatactcagttcttcttaaccttcattacaaaagttacaaatacagatgaactattttataatttttcaagttcaaattacttaaaagtttagcttgacatgcttttaatcaaactgatatttttagctccatttttagtttatatttaaaagaaaattttgcctgaagaaatctacctataactaggccatatattatgtgtacatggtgcacggaacaattcaaaatgcttccacaattacttgtttgagcttcacaaccctccagtgagggaataacgctgggattataatctccactatagagtggcttcaattctacttagagaagtgatctggcttgcctacagcctacacagtaagtttagtgatggaactggcataagaatttaggtctcctaactccaaatccagtgttgtgctttttttttaatggaatattacagactttctgccacaccgaaatattagtttcaggccaggcgcagtggctcacacctgtaatcccagcactttgggaggccaaggcgggtggatcacctgaggtcaggaaaatattagtttcatatttcacatttttttttttttgagacagagtcgcattctgtcacccaggctggagtgcagtggcgccatctcagctcactgcaacctctgcctcccggtttccagtgatgctcctgccccagcctcccgagtagctgggattacaggcatgcaccaccacgctcagctaatttattgtatttttagtagacatgggttttcaccatgttggccaggctgttctcgaactcctggcctcaagtgatacgcctgccttggcctcccaaagtgtcgtgagccaccgcacccggcctcatattggccttttaaaatattacatattttttttttataaagagtccattagtgggttccttgtctactttttctattaaattgtgtttacttgcctcaaacagaacaaggttatgccctttgtgaaagtttgaggtatagtccataacacccttgagaaagacttgtgatatcacacaatattttactgctgtcattaaaaacaagtggtgagataaagtggttttaattacacaatgaacgacttgccctattgcaaaggaagactgaattcaaaatgcttgaaataactgagttactgttttctcttctgttccaaaatattgtagtgttctacaaaaatgaatgaatttcctggtttcttttattatttatggtgaacaaatattgcacatgctggaaaaataatgattcactccaaagcagattttttttttaatttttccactgtgcaattgctttctctgtggctaagttgaacatttgggaatatccaaaggctactgaattttctacaggtttttaagaggtgtgttttcctcatatcatcggataagatttattcagaacctcttgctctttacctgacagcatgtgacccagggtgaaggatagaaaagttgactgaaattatacacctctgggagacctccagaagattgacacctatgttcagatttgtttacagtcaattgtttgagaaataaaatgtttccattttataccaggggtaaaaatgtcatctgcaagggcaaagaccattttctatatgccttctgggaaattttgtagcctctaatgtagtcccaaacatacattgaccgtctaataaatacttatttaattgacctccatgaaagtaatatatgaagagtttcaaggtagtagcatactccacagggtatgagggaagctgtttggatacagaagattgcttgtagaaatggcaccaattctctgccctttactctattcacatccttagcaatgtagtttggaagcgcctctgagccacaggtgttgcctatttccctacccgttgaatctggattgtccctatgactcgatttggcaaacagaatgtggcagaagtaacaatgtgccaggtctgagacagggcccttctgtcttggaaccagccaccatttgagcaagcccaagctaggatgatgaggatgagataactcatgaagcagagacaagatgtcccagctaaggtcatcctagatcggccagcatgtagctgacccaacagctaactacagacacacgagcaaactcagttgagaccagcccaaattgctgatccgcaaaataatgagatgaataaatggccgttgtttataagctctgaggtcttgaggtggtttatcacacagcaaaagcttattaaagcatagggaaagctggcataggaagaatcctatatccgtacccggaaaataccttctgtcaagtttcacacttctgggaagtctctataggggaaataccttctcctctttttaccccttactcatttcttctcaagagaacaaggataggtagcctgattgataaaagcctatcatttattgtgctacattttctaccattgggattaagaaagataaagatggctggcctgctctcttgctctcaccaacttgctcgcaagtggaagaagtcttcttctttctctgctccctaattctttatggaagaatcttttgtgtttatggataaggaaaggggttcaccactgtcactgtcctgctggctatggtataagaagcaggcctgtggtccttcccagtggcctctaaaactgccctaaagaaacagatctcttcacagacaagtccagattcacagtagaagtaggagtgaccattcaacttcagcttcaaactacactttccaaaaacagttcagcagttggatacctttatgtccattctcaccgagaaattcccaacaggagaagggatggagcttcacactgcctcctcaacaactttcaacagctagaaatattgacctgaaaaatgtaaatgtacaatgaaatgttcatcccttagattttctacattataatgtcactgtctttcattccaagttttgtaagagtattaggactagaatataaccctacttcttttatattcaatttttctataaaatgtctagggaagaatgacacataaacttccagtcactctattttggtacctttttatatagagatgacaggatactttgatcaaacaacagcaggtcttcctttccaatttgtcaggttttctgttcctggtaatagaattagatttttttccagaaagaaaaaaagagataaaattaaataatggacaataactaaatttggcatgttaaaaatgtctgcatttcgcacacgcatgtacgagctcacacatgaaaacatagttttttattgaaaagtgtgttagtgaacgatacaaaagtgacattttatatagtgttgtttcaccttccaaaaaacttaagaatcatacgatgtaaggaaatgtgacaaaaattgtgtgaaataagtaagatcaatatcaggagaaaaagagcctagataagtgctctatttaattcaaaactcaactttttctacatcccaggagaccctactcttgggtctttgtcacttctgtgtgtatggaattcaagcagaaccatcataactcccttttaagaaagtatttgcatttgtaaaaccagtctgaacacgtctatttctgtatactaatccaatttatttaatgtttctattcaggtttctatttcttccccagtttttgtaaacagtatttttccaaaataataagtattaattttttctaatatacaaatttattgatggaaagtggtttaagtatggttttatttaatcttgatatatctgtgattatgtcttctttttcattcctagtatgatgaatttatacttctcttatttattttttggcagtcaatcttggttgaagtttgtctatgttattgaacttttcaaagaactatctttgggttttttgttcatccctaatgtaggtttgttttctcgttcattaaattatgcaattatccataggttgtttcttcactctgctgataatttcctttgttgtgcagaagtttttcagtttgatgtaatcccacttctttattcatgcttttgttgcctgtgtttttaggtttttacccaaaaattatcacccaagtaaatgtcatggagcttttccactacgttttcttctagtagttttatgatttcaggtcttatgattaaatgtctaacccatttggagttaacttttttatgtagtgtgagatgagggtctaattttattcttgtacatgggatatccagttttcccagaaccactaattaaagagactgttcatccctctttgtgtgttcttggtatcttttccaaaattaattatctataaatgtgtgggtttatttcagggctctctatcctgttccattggtctacgtgtctgtttttacgccagtaccatgctgttctgattttctgataaagggttaatatccaaaatacataaggaactcagctcaatagtaagaaaaccaataacctgattttaaaatgggtaaatgacttgaatagacatttctcaaaagaagacatacaaatagtcaacagggatatgaaaaaatgctcaacatcactaatcatctaggaaacgcaaattaaaaccacaatgagatatcacctcacacctgttagaatggctgttatcaaaaagatgaaagataaacgttggcaaagttgtggagaaaagggaagccttgtacactatttgtggaaatgtaaattggtacagacattatgaaaaacagcatgaagtttcctttaaaaatgaaaaatagaactaccttatgatatagcaatactactactgggtatatacataaagatataaaatcagtatgccaaagagatatctgcacactccatgttcattgcagcattatgcacagttgccaaaatatggaatccacctaagtgtccatcaacagataaatgtataaagaaataccatgtacaacggtatttacatacatatgtacatatttacattgtacataaatgtacaatgaaataccatgcagaatttaaaaagaagataatcttctcatctgagacaatgtggatgaacctgcatggccttaggttaagtaaaataagcgaagcacagaaggacaaatatggcattatcttacttataagtgggatcttacaaagcaaaattcatagaaacccagagtaaaatgttgactaccagaggctgggggtaatcagaagtgaggactgggagatattgatcaaagagcagaacattccagttagccaggaggagtaagttcaagagatctattgtaaaagactacaaccaataacaatctattacatacttgcatggtaactataactaataacagtatattgtatacctgaaaattgctgagagtagattttaagtgctctcaccacaaagaataagtacattatataatgcatatgttaattatcttgatttatccatgtcacaatgtatacatatatcaaacatcatgttgtacaccatagttacataaaatttttacttgtcaattaaaaaattaattatacaattatacatgtattgttctcttcattctactttctctaagattattctcttgtatttttaaaattttctactcttaagatacatgattagctcattgattctcagcctttcttctttttctaatataagcattaaagcaataaatttcctctgaaatatatatttagttgcatcccatatgttttgatgtattcattatagttcatttctaagtgttcttaaattttatttgtaattcttttttgacccacaaattacttagcagagtatttaaaatgtgaaatataaggaagcttttaaatttgtttttattcatccttaatggtattatggtcaggcttgctttatggattaataggtggacatattttgtttaaattgttttctgcagaactatactctgcaattgagtacaagattttagatgtgtctcttagatcaatactgttgattataacattaaaatctccaaggttatccgattttgtctgcgtgatctatcaattgctaagaaggttctatgtgtcaacttgccaaattttcattgtatttctacctacttttgctgtactgaggccatgttaattgcatgtaagttaaggcttgttatatcttcctggcgaactggacattttatctttatataattatcttcttcactctgatatggccttttgtttgtttcaaactcttttctgtctgatattaatatatgtactgtagaaacatttaggtttatatttgtcttatgatatgtcaggtaatatatgccatggaaatggagcagggtaaaggtatcaagagttatggaggggtgctttgagaagacttcctgctagggtgagttttgagcagagatctgaatgaggtgaggctagaagccatgtaaatatctgggaagaaaggatctaacgtagagggaacagcataggcaaatgctacaacatgctttgtgtgtttgtaaaccagcaaggaggccagtgtggctgtggagataagatctgaaaggaaaggggctagatcatgtcgagattcataggccacaggaggattcgagaatttattctaagaggaaaagctactggggggttctgagtagagaacaaacatgatctgacttatattttaacagtatcaatgtgactgacatttttaaaaagaattattgggacaaggtagggcatggatcaagggtagaagcagagaaactagttgggagacttttgaaataattcaaatctgagaaaatggtagcttagaccagcaaagcaacaacagtagagaaggtgagaaacagtctaatttggtgtatattttgaaatttaaaaccgaatgagcttgctgatggatggatatagagtacaagagagagagaaattaagaatgagtcctatatgcttgatatgaacaatgaacacttaggatcgacatttactaaaatgaggatgactccaagaggatttgctttgtatagggtaaatgaaaacttggttttataacctgctaagtttaaggtgtatgttagtcacccaaatggagatgtctggttggctctggagttgggtctagagattcaagctaaagatataaacatgagagttatcaaatatagagatggtctttaaaactgtgagatatgataagagcacatagggagtgagtgaagatggagaaaagaagatatctaagcatggagccctaggatgcttcaatgtttaaaagtgagatgaaaagagcacagaggaaagtgagagaaagccatgtcctgaagaccaaggggagaaaatgagaatggagatgataggtcaaatggtcaagtaagatgagaactgagaatgtttcattctcaggcaggcaatgtgaaagtcacacaggaacttgaacaaagtcatttcagaaaagtgtttagggatgaatgccgtattggagtgcagtcaagtgagaatgagagaaaggagtgataatagtagagaaaactcaagtttttggtaaaggggaatataaaaatgagaagaggttatatctggaaagagagggatcaagacagatgtggttttatacttttttttaaacggaagatattatagcatgttattatgctactgataatgatgagaaaaatgattataccgaaagaaaggaaagacgggaattgcaggagtgaagtcctactattccagaggtcatcaaacttttttctggaaacggccaatagtaaatattttaggcttttgtgagccatactaatcaactttctcattgtagcccactaaagcagccataggcaatatgtaaacaactgagcatggctgtgttccaatactactttattttcaaaaacagaaagttggctagatttggcagtagtctgccaacctctgttctattcaataaataattcctggattggaatagaattcattttaacaaaatggaaaattgtttactacaaatagtatagttaaatggaatgaaatttgtttaatagtaagattccacattaatgagttgtcaccctacagggaagatcctagatctggaccacattactctctacttagtctcattatatttaattctcaccagtacctagtataaagataaggaaaacatgattaagattacatagagctgagagggaaaacattctttgacaaaaaaatcgaaagatgtcaatttaagcaggctactgattttgtcgaagaaaatttacagtaaaacataaattatacaatttcagtagacctaacatagaaatccatatacaaaatacccaaaggtctcagttgactgtaatttaaactccatattactcaagagcaacttaatttccaaaagagttaacactcaaaattaacctacactgataactatctagcatccagaataaaggagagactcatcccaatgtgaagatacataccctatttcaggcactacattttaaggagagtttctgatcagttaaagcccattcaagggtgcgtgaactaggatgttgagaggtcagaaaaccattttacataaaaaaacagttgaagcatccaaggacatttaatacggaaaagagaatatttaatataggcatgagggaagtcttcaaatacttgaaggactagcacatgaaagggaaaataggcagccattggttataggatagcaatttctaaacaatggaaagaagactttaatggttaatgagagctgtttataaatgcttccaagtgagctggagagctccctaaaagtaatcaagcagaggctaggtgttaaaaaggagatggctttgctcttaataattatgccttttcttttttatgaataaacatgaatattacgtagaatagaccaagtgcacatacatggaaattatttcaaaaggtttttttaactgttaagctcaggggtacatgtgcagatttgttatgttggtaaacttgtgtcataggggtttgttgtacagattatttttatcacccaagtattaagcctagtacccattagttgtttttcctgatcctctttctcctcccatcctagaccctctggtaggcctgagcgtcggttgttctcctctatgtgttcgtgtgttctcataatttagctcctacttcttagtgagaacatgtggtatttggttttctattcctgacgttagtttgctaaggataatggcctccagctccatccatgttcctgcaaagtacatgccctcattctttttcatggctgcatagtattccatggtgtataggtaccacgttttctttatccagtctactactgatgggcatttaggttgattctatgtctttgctattgtgaatactgctacaacaaatatatgtgctccttgattttcttatcagtaaaataggagcaacatttatggtctacctcttggagaatgtgctaataaattaacagcggctccttctggttttttaagggactcctgaaaggttaagatagatttggtctgcagctggaaagtaactgaaccatggaaaatagaacatcactcaatactttttgtcattaaagaagctcttccatcatgacacttttctgctcattttatatattttcccgcaacagtccacaggctctgcctggcctgtcagccacagggttcagcaaagcaactaccaagccatcatttttccaactcattagaccatattattagagctgttgctactacagcccttataactcaaggcataagtatgtctgagcctacaacttagagcttatccttcattttcttccattttattttattatttttaattttatttaacaacacaagaagaacattctctcaggtcttagattgtattttgctttaacatgcttttgcttaccaagctatatctggaagaggtagaagaaacatctccttggtgcttctccattacagaaaagggcaggtcatacattgctggtagcctgaggtggctctgaaatgatctgtcaagcacacagaatgccaagctttgactgtttcaacattacagaaaagcaacgctccagcatgccctgcctggcattgtcctgttccggatgtttttctgaccattttattttactgataaattttacaacaagatgcaattgtaaggactgaatgtttcttgagaggcctttcttagatgttcatttctcactattatttgctttgcccctagaatcacacaggctaaaaatctaattacatttgttgacattcctctgaccacttatttttcaggtgcacaattataaaactacactgacaacacaaccatagctaacaatcacacagcattttaccactgataaagtgctttcatgtacatcatctcatggaaaattcccgggtggaagcttattcaataaacgttttccaaaaaagcatttgttagaagccaccacaactgaaatagtttagggtattttaggagcaaattaacgagatgggatctgtattgcccatcacaataattcacattaaacaatatatacaagataaaagcaactagacaggttctgagtaaatgcaagtttttattttatgtgtgtcagacataagtctcagcaatattagtttcctagggctgctgtaacaaagcacgacaaattgggtggcataaaacagcagaaaatttactctcttacagttctggaggccagaaatccaaaaacaaggtgttgtaaaggttgcttccttctagaggctctgaggcagagtctattccatgcctctctcttagcttttggtggttgctaggaatccttagcattccttggcacatagatcaatcactccagtctctgcctctatctttgtgtggcattctcccctatggcactgtatatgcatttctgttttcttataaggaaacaagtcagattagggcttaccctatgaaagtatgacctcattttaatttgattcaatggacaaagactcttatttcctaattgttttatttccttatttcctaataaaagcacattcacaggtatcgtggtttaggacttaaacatgtcttttgaagggttacaattcaatattagcattaattaatattagtattaatattataatatattgtaatattatattataatgtaatattagcattaattaccagccttatgaaccagtgacaataaagttatgtctctttatatactctaagtgctataatccctgcttaccacagagacctacttcttaatgagtttgccctacgtgtcccagcaatcttttgtagtctggaaagcagagtcctccagaaaaagttctccctttacttccgctctggccttcccattctgtcaccatatggctaccctgggtaccaatgatcttgatttctgtgagaacagtggtctgtctcacacagctacatatgctggtgactgctactaattcccattctagcctcaggtttgggcataccgccgatgggactagagctcagatacacccacttgaggctaggggctccaacatttctgcctggctaaatccctggcctcttgctgccactgctacctttgcctgcagtgacaaatgaaggaaaagagttgaccgacctggatctgtctccctgtgtagaagagaactggacttacagcaccaaaattatgctggttaactttttgattttttttgtttttttttttttttttgagacggagtctcgctctgttgcccaggctggagtgcagtggcacgatctcggctcactgcaacctctgtctcccgggttcaagcgattctcctgcctcagcctcctgagtagctgggattacaggtgcacgccaccacgccctgctaatttttgtatttttagtagagacagggtttcaccacgttggtcaggctggtctcgaactcctgaccacaagtcatccgccctcctcagcctcctaaagtgctgtgattacaggcgtgagccaccacacccggccagctggttctctttatgtttcagagtctaagccaatttaaggccttttctataccagggcaataacctaccccctttcctgtcttaggacaaaactcttcccaagaagcaaacactatgaacatccattgccctcagggaagaaggcaccacccctcattagaacgtaatcttctcccatagtctcaacaatcaaaaacaaatctgctattctgtgattcagacttatagttgactatgcaatatacattcttccccctttccttagtagcaaaataattattttgttgggtgtggcaatggacccagaaataaaatatttgtccaagcttccattgcacataaaggtggccaatgagatatagacacaggtctttcagcaagactttttgtaagtttctttacaggagcctaactcacctcctttttcttgcctgaaacatggctggagctgcagcagccctcttcccaccaggacgtaacctcaagattaacagctgcacattaaggatgatacagtcacaaaacatagacagaacctaagatattagttatattgtgcagccaccaaaacagccttggacttcttttacattgccccccttctttctccccgaccccaggggggacattttgcaatgtctggagacatctttgattgccacaacttggggagagagaagtttactggcacctagtatttaagtgtcaaggatggagctaaacattctatattgcacaggaaagtgttctacaacaaagaatcatcccacccaaaatgtcaataattctgaggttgagaaccgtgtgttcaggaataaaaaaaaatctctgtgatttcaggcctatgtttttagcagtcaaatgtaatttttagtacacattagaacaagtctcaaaatcagggttgtttcatcattcttactgctatgtcacgtatataagaaccagagtgaatgttaaaatgtttccactgtatgactcaaacttctttcatttactattttcactgccaagagagatcaatacttatgaacactttatggtgctactgggcaaagcatcattaacgaaggttattacagccctgctgtctgagttgaaagcaacaggcttggttcctcaaaaagttaaacacagagttaccatacaacccagcaattccactccaaggtatatacaccaaagaactgaaaacaggaattcaaccgaatatttgtacacaaatgttcataacaatcctattcacagtaaccaaaatgtggaaacaacccaaatgtccatcaatggatgaatggataaacaaaatgttttttatatatatttacatatatatatatataaaatcacattatatattataatatatacatataatcgcatttttatggctgaaaaacatcccattgagtgtgtagaattggaggaaatgaacattcttcccattatgtcctaccatgattccttaatccataaataactaaaagaacttaggaggtttatttattttcccactttagttcaaattaagagctctgccaataatcttgttgtagccctgctgaattgaaagcaacaggcattgtgtgtacacacacacacacacacacacacacacacagaggaatattcagccattaaaaggtataaagcaataggcaaatcctgattgtctctggttcagaaatagtcattcaggacctaccaaatttcatgagggaccagattatttgcctagaaattagactgactgagggaaaattcagcatctagtgtttcaaccttgtacaaccagtgctaaacctgctgtcttagcactagttttctgtaaggtttgggaattggtcatcttcagttcccaaaccttctcagaataactgcttcttccctgaagggctgctacaaaaagggaaaatggtggggtaaaaattttgagctcaaaatattggtatcaggacctctgctgaaagactggtcaagggctcagagccaggttccagcatctccttctacaaggttctttccaaatctggtggaataatgctgtaactggatagatattaaaattgcctcagtctaaaatatgcttggcatcactctggtgaagttccttcatatcataagagatctatttaaaggttctgttgaatatattttagaaatctatgaaaaagctaggtttgcatgtcaatctatttgaaactagaattaaattcacttttcaaatagctttttttccctaactaggttattagcagaactcttaatttgaaataaagtgagaaaaataaataaacctaacttattttagttatttatagataaggaatcatgggaggaacgttcacttcctccaattctacaaaagaaaaaaataccctcatgtagacctcataattcagtaattgattaattttttttctcattttagcatgtgagttcaaacaggaacaacttcctgcttgaaaaaggtatttcaacccgtcttctgcctccatgcaatgactatttatggctacattcacactggagcaattaaaaagagaacaatagtcctgcaaacttatacacatacacatttgttttcaaattagcccatacatatcatgtaattgactaagtattgctattacctgtgattcttagaaagaatttaaggatccggcagggcgcgggcacggtggctcacgcctgtaatcccagcactttgggaggcggaggcgggcagatcacgaggtcaggagatcgagaccatcctggctaacacggtgaaaccccgtctctactaaaaatacaaaaacttagccgggcgtggtggcgggtgcctgtagtcccagctactctggaggctgaggcaggagaatggcgtgaacccgggaggcggagcttgcagtgagccgagatcgcgccactgtactccaccccgggcgacagagccagactccgtctcaaaaaaaaaaacaaaaacaaaacaaaacaaaggaaagaaagaattgaaggatccattggtcctaccaaaaattgtttacatatatttctaagcttaaactagctttagctttaccaactacatttttatgagataaatctaaataaactagctctagctttaccaactacatttttatgagataaagctaaatgagttggcaatcagattctttaaagaagtaataacaaaaatattaaaattaaatttaagttagtttttaaccatcaaaccctttgaaaattccttctaaataactcataattacatctttcagcacacagcaactcacccagaattattttgcacccatcttcctgcaagttatgtaaagcacgtgaacccacatccaaattttataaattgtaactatagttatacaattaattggtcaccttcattttagaaccaagggtgtttatgactctaggttgtttaagggcagaatatatgtgtttcttcagtatttaatatgtaagattggtagaggaatagctggaagttgatagaggtagaagttgtgaaatcaatgagatgccaacaacctggggaaaatgctataacagattttgctggtgtcccatctatatcccccctaccctcatcagttcctaaaagccaacttccaattgccaatatctatatttctttgccggagggatttctctgctctccaaagcccactctttccatgcagacggcaggttagaaatgtcaaggaattagctcgtcaccaggaacagcccccaatcaatgagtgtcaggagttcatataaatacccctgctccttgcatctcagaggtataacttggaggcatgttctacactgcctttctctccttctctctctttctctctgtcacacacacacaaacacacacacacacacacacacacacacagaaacatgattgccacaataaagtccacatttcccagccttccttgtagatgaatgtggctatgtgataagtgttcaacaatgaaatgtgaacataagggatatgtatgaattccttctcacttgcttcaaagaaatcatttgccattgatttattttctttcttccttcctgcaagcaaaaatatgggtgttccaaagatgtagcttcaactatgcagatgaggatcatgtcttaaaggatggaagatcaatgacataaaagtcccctgaatggcaaggctcaataggaatgaatgtcctgacactgtattttgttctcttggttatagacactgttcttttactctaatagagtattcaaagaaaaacagaggaaatcatctacacagtagcatgtcatgatatgacatcactatacagtgaatttctaagcaaattccacatctacactataatgatgcaatcagctctgacacccagatctcccactgttatcacatattcgctcttcagtggcttcttcaattttatctccaactctcataagctttgacatgcttgggaagcatgaaatactttgtgggaacgttagccactgagtacatatctcaaccttgcttaaaatcccccgaggagctaagaattgtaataggacaataaggaaatgtacttcaactttatcaaacattatctctaatgtgctcataatgtcagttcaaccaaattagccacatgctacattgacatcatctgaaatgatgtaattctccctgctgaaagcctccatctgagtgaaaggctatgctcttcaagagaatcagccaaggagggaagaggagagaaatattcataagcagaatagtttcctatcctagagcagatggatttttgttgcctaaaagaggagagaagcaaaaggaagggtaaaatttagaactgttttattcaggagtaatagctttaaaattgataaaccaggtcacgatacctcttccaacagaacaaaataaccaacccagttggatgaaatataaaaacacttttattgattttcaactaataagttgaaagttattaacgttcttttaaagtaatagtttctcccaagattcataagtatcactctctttaccaaacctgtatctttctactgttcccctgcatgattagtttaggaaaatacagagaacatatttgcttactaaaaataccaaatactccaaaattgttgggacacacaaactcactcccagtaacatcatgttctggcccaagatactctgagactcaagtttatatgcattaatggcttcaatatgttccttgtcctgggacttagtcattcaattatttgaaaagctttctgtgaaactatttctatggcaacagttctcaaccttggatgcgcatgagaatcacctggggagatttcaaaatttcaatgtccaggtcataccctatactaattaaatcaatactgatagccaggaatttgtatcagtatttggtagttgggggggaggggtggggggcaggaagtggggatgtttaataagtacaaacatatagttagatagaacgaataagttatactatttgatggcacaacagggtgacaacagtcaacaacaacttattgtacattttaaaataactagagtagtataattggattatttataaaacaaagaaaggacaaatgcttggtgtgatggataccccatttaccctgacgtgatgattatgcattgtatgcctatatcaaaatatttcatgtaccccataaatatatacacctactatgcatccaaaaaattaaaaattaaaattaaattttaaaatcttctcagatgtttccaatgtgcagcaaaggttgagaaccccttgagtagatcaagctctacatttagttaactatatctcctgggcgtcctaacttttctaaatgggagctttagactagatcttcaagtactaagaaccaactcaacagtcaaatatttataaggttccgactatccaccaggctccatgttcagtgttggaaatgcaagactgaaaaagacatcttggtaaggtagtaggagcagggcttctcaagctttaatgtgtacataacccatctggagatcttgttaaaatgtgggttctgattcagtcggtctagggtgaggcctgaaactgcatttctaacaagcttcaaggtgagatgccaatgctgctggtccatggaccccacattgagtaacatggagagttgcaaaatgaagtaatgtctactatgaaaagtgcagggtgctctggtatgtctaagaatgaacaaagtctacaattctgtaagatgctggcctcctgcagtttttaatcatctttatctctccctcacagagagctttctaatctttgttaaaaaaaaaaatctgtatcctgtcccaagtcattgttacagaagggtctacaaattttatgatttgttcaacagtaagcccacataaagtgctgcaaggactattttaaaaaacagtgtgagaaagtaacattgtcaaaaccaaaattgatgaaactcaaaagggaaaggcatgaacacaaaatctagaaagagaaaatgtgtgtcagaggaacacagcattggaaggcaactaggaggttacctttttattttcttgccctcttggtgagttcctaattcatactttccccctttgtctaaggaaacgaaaggtcgtgtgcacttgaaagcaacacttggggagaaaggtgccttcaaaatccccaacacctagatttttgtcataaataactttaaagtaattcaaactttaagagttcaagctataacatttcaattaaagtgagactttttaacaaagagccacctatttatattgattctttgacacaatttgaagagaaataaaaatgtattgtttctacttggtaaccttaatggtaaaataaaatgtacagtaaagtctttaagtgtctcaacagccctttgatccctttagattctactgtgaccaaatatcaaagtcacgtttaaattcttccaggaagaatgaaagagtgacatgttggcatgagtaaatgatactaggattccctgtaaattaattaaatgattaatagaatatgatcctcagtaccaaaaaacttacagactaatggaagagatgaaagacgaggagtggtaggggaagagaaagatccaagaagatgaaggcctccataggaatgaagaattattctcatggtgtttgtcgtttggagagttcttttgacacacatacatctccatgctacaagttaatattaaattcttctaacttgttatcactgaaaagagaggttcctccctacaagggagttactatgtaacctgtcctcaccatgcactagattgagttctagcgttatgggcaatatgacagaatagaaagtgaatggtctctggttctaattccagctctgcaacttcttagatgtgtgtagttaaaaatcgggcaagttatttaaattctcataattatctgagttttagtatccttctctataaattggagataaaaatataaaattggtgggatcgttgtaagaactaacaattctgtatttaaagtgtctgacacttcaaaatcactttgcaggtgaggggcagagcagtgcatcatgcaggatcccaatgaagatacagaatggaatgacattttaagagatttcggcattcttcctcctaaagaagagtcaaaagatgaaattgaagaaatggttttatgtttacagaaagaagcaatggtgaaaccatttgaaaagatgactcttgcacagctaaaggaagctgaagatgaattcgatgaagatatgcaagctattgaaacatagaaagaagcggttacaggaatggaaagctcttaagaaaaaacaaaaatgtggagaattaacagaaatttctggaaatcagtaagtgaatgaagtcacaaatgcagaaaaagacgtgtgggttataattcatctatacagatcaagggtctcactgtgtttcccaggctggaatacagtgacaattgtatagctcaatgcagccttgaatgcttgggctcaagcaatgatcctcctgcctcagtcctccaagtagcttggacgacaggtctgcaccaccacatctggccaggttttaaaatttttttgtagaaatggggtattgctatgtcgcccagaccggtctcgaactcctggcttcaagtgatcctcctgcctcagcctcccaaagtattgagattacaggcgtgaaccacagtgaaaaaaaaaataataataactttgcaataaatggcagaatcaggatttgacaggttctgtctgtttaacactgccaagtagtgtgtgtgtgtgtgtgtgtgtgtgtgtgtgtgtgtgtatagatagagaaagaaacagagaaagaggtagattctaaattgttaacctttgttacatctggagagtacaactgggcttagtggtagttagataaggaagaatgtgataagtgagtttaaaaaaaagcaagcaagaaatatttcacttattacaattgtataatatttagattcttatagcaaccgttatcacttttgtaataaaaattgaggccgggcacagtggctcacgcctgtaatcccagcactttgggaggccgtggcgggcggatcaagaggtcagcagatcgagaccatcctggctaacacggtgaaacctcgtctctactaaaaacacaaaaaaattagccaggcatggtggcgggcacctgtagtcccagctacttgggaggctgagtcaggagaatggcgtgaacccgggaggcggagcttgtagtgagccgagatcgtgccactgcactccagcctgggcgacagagcaagactccgtctcaaaaaaaaaaaaaaaaaaaaaaatcaaatgtggaaaaacaaagaataaaaaataaagcgtctgacacttaagattctttaaaattgttattactgttttctaataaaggtcataagctcattaaaaccaatactacggtttgtctttgtaattccctttgattcagatgagcttaaggatttaatggtgctgatgacctaagcatttatctaaacatgatctaattcttgggtctcttttctcttgctgacatgaaatgtttagggcactaaagcaagcaaacaggaggcctgtgggcccagtgcagcaaaccaatgttttgtttgatttgcacagtgctcaataaaaatgttaaattagttcatgacatttgaaaatcagaagatttaatataaatgtctagatttctagctccttctgaaaaatcagaaaatctggcaacactgccccaacaatcatgcttggcaaccatcagtgggagctgaaaaacaattactgaacccgttagacacgatgtgttctctgcaatttgctgctggttccacccgatccattgcattccattaagttaggtaagtggtccttataggcatttgagcttgagactgtcactctccagggaatttttttttttttttttttttccagagaaaccacaagaaatgattagacaactaaattacctctttggaactgtagccaagtttcaacttgagtttggacacacaggaaaaatttagaaggaaaaacaaccaggggtatgttttaagtggaactaaggagttcaaaacaataggtagagggacatgagtactgtttttgactcacattatcgtccatggccctgctcccctgtactcacaccccatgctggagtaaatttgatttatccaaagacggaatactaaaggaactgcagggcaggccgtcagctgctttgatgacattagtctcagcagcaaaagaggctaacgcccttaatacagataacagcaccttcacaactatcataggcactcttggggaagacaccagccacaattaggagagggtgaccaccttgtgggcaccagaatctacagagccttcagtaagactcatcagcaataactcgtgatgttttcagcaacagtgtacgcaagagaagaagaagaaaatggcagacgacggaatagaaaagtattcaatgggtttgcacttttgtgtgcacttggaacacacaagagacacatcctgtactcttccagaattatgtgggctgattctgagaggtagattcccatttgcagggggcagggactgaagctagagaaatattgttggtgattatgatcaaaactctatggttacccacaggatggggtaaaaattaaaaggcagtccaacagatgttatcagttgttttgaaaacttgtcagttgataattaccaatctgctctgtttaaaaaaagtcacttctcattaaatttatttaggtgtattaagcagagactcagattttcaatgcttaatggttcatcctagattgtcaacacactgactgttttcccttgttcatcattggcaaaggggacgacttggattttcacgtggttcaacagtacacacagttgctttttctttcagctcttacctcggtttgttatacagaaaaaagatgaaaaggttgaaatcccactgcttgtaggaaatgtctgttggcattcttgaaagtttcattctaaaaaagtctccttggcattggtgtgcctaatttactgtgactggcacccaggataattctagaaacagtaataacttaagggtaaaaacaatttcacaagctgagtgaatgatatatgggagcccggtctctttgcagctcttctgtaaatgtagaagtattttaaaatgaaaaggttaaaaaaaactttacacttactgcctgtttatcttatcaagcaaaagattttcagcaattgagagacagaagaattcggtaggaaattaaatcaatattgagggtatattttcatttccttaagatttatatgtgattatcactcaatattatatttgaaattctattccgaatcaacttttgaggcactatcttaaagcaagctctctttggttgattattttaatgataactcaactctcagtggttttcatctgacttctcctcccataggcagcagggaagattttgtttcagagttttaggataatacgatttagaaaaatcttatacagaaactttttttcctgttccattcttggcagatacagccatacttcaaatactttaggggcttacatttgtctaatagtggagccaaagttgcattattccttggagagcttaaaagggccaagaattgagagtcacaaaatacctaaggtatggaaggaaactgctcagctattgtatttttaggtagctattctagggatagctctaaggatattctgaaatttctctttagctgtccctcattctagtgatgatgatgctgctgctgctgctgctgatgatgatgatgatagacatatgtgaatccttaatgagtattaagggacaggtaatttgctaattaatgggtttcaactacattatctcatttaattcttgcaacagagctataaagtaggtaatatttatttttcctattttatccattaaaaagttgagtcagtaagaatttgttccataaaacatatgtgcaagaatgtcacattcccttatttttctagataaaattaaatgtggttctaaatccccaccctaatggtcaagttttggttccactgaggcttaagtaaagccaggaaaggagaagtaggcacagaaaagtcatccactgtggtggtatctatcattctcgttgctccatctgcttaagtagagctctgttgagctctggacctcaggcagctgttggccacttcaggctcacagtgattctctttactgaccacaagctccggtagagatctcagcatgtggttgccagatttagcaaataaaaagacaagatgcccggttaaatttgaatttcagatgaacaacaaatactttctcagcataggcatgtctcatgaaaacgtgaaacaaatctttgttatttgtctgaaatttacatttaactgggaatcttatattttactgggcaatgctatctgtcagcagccatcaaggccacaacacttagttttcagccactgcattcatcccacagctattttccatccaggagggacagatagaggcagggctttgtgattatgaaaacatcctggttgtatccagtgctctgttccccactagcatagctatatagatatcaaaggtctgataaatactgaccagctccactgagtgctgaaaaaaacaaaaaagtggcagtggaaggcaaattcttctggtgaaacctggtcaagaggttaactccctaagtctgcagtaaccacgtggcagagaactcaggtggacctgcctcaacataatccaagttcagtcccctaaaccactctgcggatggctctcagactagtaacattcagtgtcacctcatcccccaggacctctcacctggaactccagccctgcaaatgcacttgcaaaagaccccagctggccatttaaaacaatcacaattcaaaacaaaacaaaccatctttactactacatgagcagtagatttgcagatatcttcagtattcggtttcatcacgttattcttttatccttgttttctttcagcaattctttttaagactgcctttcacccaaaaccataaaaaccctagaagaaaacctaggcaataccattcaggacataggcatgggcaagcacttcatgtctaaaacaccaaaagcaatgcaacaaaagccagaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaataaccccatcaaaaagtgggcgaaggacatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactggtggtgggagtgtaaactagttcaatcattgtggaagtcagtgtggcgattcctcagggatctagaactagaaataccatttgacccagccaacccattactgggtatatacccaaaggactataaatcatgctgctataaagacacatgcacacgtatgtttattgtggcactactcacaataacaaagacttggaaccaacccaaatgtccaacaatgatagactggattaagaaaatgtggcacatatacaccatggaatactatgcagccataaaaaatgatgagttcatgtcctttgttagggacatggatgaaactggaaatcatcattctcagcaaactatcgcaaggacaaaaaaccaaacaccgcatgttctcactcataggtgggaattgaacaatgagaacacatggacacaggaaggggaacatcacactccggggactgttgtgtagtggggggaggggggagggatagctttaggagatatacctaatgctaaatgacgagttaatgggtgcagtacaccaacgtggcacatgtatacatatgtaacaaacctgcacactgtgcacatgtaccctaaaacttaaagtataataataataaaagaaaagaaaagaaaaagaaaataataagaaagagaaaaaaaaaaaaaagactgcctttcacatttaaactgccccaacagaaagtgcttgtataagggatccatgagagaaatcctaatcaagggaagccagagaaatattttccctcaatttgttcttgtgttggcattccaggaccatgataatttcatcgctaaataaatacatggacactaaggctaacctgcaaggaaaggccagcaggatctcggtaagaatcaccttcactccctaatctataaaaggaagcacagatttcaaagcaaataatgataatgatgctttaaataaaacttgattaatctcctaaatattaataaatacaccaatcacatagttctagatacaggattaatattacagttactttctccttaaagacaactcagattaagaggcagtgaatctgttaatctaatcatctcctttttttttatttaacaaaactgaaagctttgcaaccatctggttaatgattcatataaaccactggcaaaaagaaaattacctaaacaatcctaatttatcgttttcagaacatctctgtctacaagtatttgattcaatatctttatgcatcatatttttcaaaaacagttataaaaaatttggccaatagtaatgaaatactttcccttgtatcagaaaaaaaattcaatcttctaatttgactcttttatcttattatttttagtctttatgttggagaacaatggcagaaaaaagaaagcaatttggcaatttgggcatgaaatgaatatattgcacatttgtaggccctcttgaggtgtatgttctggttttgagccacatgatgatggccattcatgtgaaattggtagtacacttgtgctagattttctgaccagagctggtcatctcaaacattatccacctttgctattctgtttcagattctagaagtcaggtcccaacaagatgctgcaaagtgaattagaaagcattagatggaaaagctgagaaatgcagctattaaaatttcactgcatttctttcttagtcttttttttctcagtgaagatcatgatctgactgaagcccattatttactgtcaattgcaaaacctttgctaaatttttcatgaggtaaggaaaaaaagggcaggggataaaaggaattggaaaaacacttgggcaatttacattccatgaatcttcccaactttatctataaacataaacttttggcaactttgctgaaccagatttctagctgtttatcctcatgcttcatgaaaatcaaacaaaacctaatagtgcatctcagttaatcacttccacgtactgttttataattcattgattcaataattcgaccataatcagtcatgccatgatcatctagtataataaacgactcaaatcctgaactcgtagtctcagtaactatatttattgacttaaaatctgggacagaaaaaaatctgggttttatactaagcatgtaacacttggaaattaaccatgattattgttactattttcaaacgtactaaaatcaagcagactgcagtaatttctttcagaaaagaataggtatgtttccatctaatggtggcctaagaaaacaaattgaaccggtcagagtttgccaaattcaaaactcctcgggaaggagtagtttttcaaaaaactttcgagccctgggacacttgcttataaagaaatgtacataggagaccaaattataaatgaagtaaagaagacctttctggtgaagtaagaagtagaacaaagcaaatgttgatgatacccacccatatccttacaggctccctggaggtccctcaaacagttctctgacatgcagtggcttcctgcaactctctgatgggcaacatattccagcctcagcagcatgcttggcccgtgcccggggcaggcttagagtgctgcgtgacccatgctccagaagccaccctcaatcattgtggggtgggggatggaggacaaataccctagcttcctcacccctcaacaggacaattctcaggtatggttcatagagtttctcaaaggcttcccagaacaatgcatcccacgtttcccatagcagtaacttgctggttaatgtactttttactggctttctcccttcccaatctcacttcatttcctcacagtgtgtcttaggatcaccttacaaataagaggaagggagggagcagacagaaccatactcatcccgacaccccacaccagatggacccaagggatcctttgaactttgaaaaccagagctgctctaagtcactttcctcatttcacaagggggcgaggcctgctgcaaccaacacttgacaagttcgcagcataggctgaacaaagtatgcaaccttgctctccactgagcacctgcacccacctcaagttccaccacttctctggagttcaagcgcagcctatacacctcaactacctccaccgacatgatagaacaggccccaaaataaaatggaatacttctgaccttaaatgaatataggcatctactgcttaacatcagaaatccattcctgagtttcctactatacatctagggctctcttactatttccaatgggaaaatatgtaacaactgaaatcctccaaccaatttcttaaaacatacttaaaacacagtaaaatacatacacacagagagatatcacaggatgcacaatgttcagatccttgctttatgatcatccattcatagacttgttaaaacagagcttctttgtttgcattaacactgacatccctcttagcacaggtaacataaagcaagcatatctcttttcttgacactctggtgcatgtaaccaaacttctaaacgtgtgtctgacattctaccaatattctgctactcaacattggctgcatgttagggtcacctggtcaactcttaacaatccctatactcaggccaaaccccagaccaattggctcagaatttctgcatgggatcccagacatcactattaaatgattccaagtcaggcacagtatggcttatgcctgtaatcccagcaccttgggaggccaaagtaagaggatcccttgaggccaggagttcaagaccagcctgagcaacacagtgagaccctgtgtctataaaaaatttaaaaaaaattagctgcgtgtggtggcgcacatgcctgtagtcctagctactcaggaggctaagatggaagaactgcttgagcccaggagttcgaggttgcagtgagctgtgatggtgccactgcactccagcctgggcaggagagcaagtctctgtctcaaaaataaataaatccaatgtgcacccaaggctcatcaccatgccagatgaatttggaatgcatatcaagatttttcctccatgtactttttttaagtaatactgtctagggtttgggggatgagatagaaatcttagcatagagcatatgggcggaaaaaatattggcttgagaaatacatgtgttctgtgaagtcaggtattaaaaagcaggaagtgttccaccaggaaaatacaggttctcattggagcagttcaaattttatatttttggatgctcaactggtaagagtaatgcaaatatttcaaaatctgaaaaaaattcaaaatctgaaacacttccgatcccaagcatttcaaataagggatgctcagcctgtaataaccaggaggtgttctgtggggtacgcttgttattattatggaggggctttcatagtgtatgcataattgtagcaaggaattttgtttgtggctttataaattactgatacatctaaattaaattttctgctcaaaactcctggattatctcataccggtcataatggtgattattaaaaagtcaagaaacaacagatgctggtgaggctgcagagagataggaatgttttcacatggttgatggttggtgggagtgcaaattagtgaaaccattgtggaagacagtgtggcaattcctcaaagacccagaagcagaaataccattttacccagcaatcttatgactgggcatatacccatagggatataaatcattctattatatggatacatacacgtgtatgttcattgcagcactactcatactagcaaaggcatggaatcaacctaaatgcccatcaatgatagactggataaataaaatgtggtacatatacaccatggaataccatgcagccattcaaaggtatgagatcatgtcctttgcagggacatggatggagctggaagccattatcctcagcaaactaacacaggaactgaaaaccaaacagcacatgttctcacttataagtggaagctgaacaatgaaaatagtggacacagggaggggaacatcacacactggggcgtgttggggggcatttcaggggcagagcatcaggaagaacagctgatggatgctgggcttaatacctaggtgatgggttgatctgcgcagcaaaccaccatggcacacgtttaccatgtaacaaacctgcacatcctgcgcatgcaccctggaacttaacattaaaaaaaaaaatctggcgtttatcttatccgttctctgctactttatttatattttaggtttaaaaataagtttcatctatctaaatacaaaaggaaactgccctgcttgaaatcttccaaataggccatgttctctctcacctccaggactttaccgttgctttgctatctccttagaataccctttctcacctgtatttgtatctccttctcctagatcacccctcatcctttgagactcacctacaaagtatctcctataggaaaacttcccttaatccccaaggttagattcagtacctgttcgcatgggctcccatagcagcctatcctcacctcaccgccttgtaattgtttcatcactttaagctccatgtgaccagggactggtaattgcctggcccacagtaaatgtcgtaagtatttgttaaataagggattgaatctagggctattcgttcccagtaccaccatcaccaccaaaccccaatcccaccgatacctcaatcaaatattgtcccttgagtcacatgtcctggctgctgttaaatcacacattaaaattaaaatctttaatgactagtttgggtagtgttactgatgcttgggatgtgtcagcaggtaatgatttgaaattctacatcacaaaagcatttcttctactccctaatttgtgacagccccctccacaggactctccagaatcctattgctatctttggctcaatagtcaaggcccttggtaagatggatagcatcagtacttcaggggtggtggacagatgttattccaggacaccattcctgccgatcctatcccagcacagtctagtttgtacagcctcttgactctctgtcagtttctgatatggtcatatgggatgtggacacaaacgctaatttattttgtgcttgatactgtcaaaccctatctgcctttctccctatgaatgggattccatcctggaattcttgatgtctttggtgctagttgtattactgcagtcaaaggcaacatcaggctaccttagcctaaagccactaacaccctaagctgtatcccacattcaaatccttaatagaggaagaaaaaatggtgaagaaaaaaaatgaggagaaaagcaagaatacatgcataagcaagcagtacaagaccatgttttcctaagttcagaatgagttggaactttgtaatatttatgttcaccatccaaataaagtatttagttcaattttatttcttgctgacaaattctgcctcttcaacctaaggataaaagctgaaaaagctttttcagatgtcatttgcctacacaaaacaacattctgatgagtagcaaagcatctattaattagaaacatatgggaactgacttccctcaaattaaatgtagttgtgaaacttgagaataaggagaggtatttggcaaaacattcttgagttatgctgaatgtacaaaacttattaagagagatatatttatttaagtttaaaatatggctacattttcttcttctagcaagtaagccaactcagcaaaaagtcttcatcagtaagagtatcatttttatttatacatatgaatttattatttgactcatagattcttttttaaaaaatcaggaaagaatggaaggaaaaggattagggagaaggctttcgctatacctgcaacattttatttcttaaaaaaagatttgagacagggatggcaaaataacatccatcaaatctggctggtatgtgtgtctacttaattatattctatatgtttgaaaaaaatcacacgtttttgataaaagtatgcaagcaatatgtcagggtagataagaacacgggaatttgtttgagacacctggttctgctgtttactagctccgtgaccttagcaatctctctacatctcagtttctcaatctataaaataaggaaattgtgaactgcttcctagctgaagggtgagtactatccacaatttaaagcaaatacatgtgtgtctatgtcttagggcaggtttccctagaaacagactttgagacagagatttgtgcagtactctcattggacagtgctctcaggaacaccgctagtcaggggaggtaaagaaagccagattgggcagagggagaagttgagccatgatgtagtcacaacagaggcctcggccaatcctgcgggggcacactggagctgtagtagcccttctgaattatccagagtcaaggaaaggggaccaaacctttctatctctacatctactttaaacaatgggtgaaagctacccctggggaaaggacataaccttgggtgtggcagtgccttcagccaagggcaatgcctggagaggatgtaagatgagaactatcagcaagcaacagccccaccagctgaggaatgacggcctcaactctcaagggaggatctgagttaagaaccacagcacccctgatagtttgtatcagcctcagcaaaggaaggaacatggtgaggaggtagaaaaacaaggggccaagggataggatgggatctgaaagcctatgaaacaaggttggctgtggccacagaagagctctgtaagccagacacctaacattccttcgatcttgtagtatgtccctgctgttctctagcaaaaaatttattagtaaattccaaccaactgctacttgtgccaaatagtttaagagggaagcatcatacatacctagcattaatgtgatcacaagaacaggaagccaagccaaagaacccaagaggaaggtgaaattcaggtgaacatatcgggccattgagttagccatcccttctccctcactgcacccacaccagagattcactttccagagctaaaccttggagtcctggagtctgttttaacaaggagaggactatttccttattgcagccccttctccccatctttcagaatgttataggtaaactggggcaaccatttcatatctcaagagggatggagtatttttcatttttttttttttaccacttttacacattcatcctttttagaaaaggaaatttaaactttaaagcttgcttatatatatagccaaaaacccttctctaaactcaaggcagcattctcaagcaggctgtggtatcaaagtcagtaataatttgtacatgaaatttagagaccacatttaaccaggtttttaaacaccatacatgaaactaccaattttattatatcaaccattgccagtcacttattcatagacaaatgtcctgtcatgtgctcattttattgccccaatcacttaatttggattcaatatgctgtatagagtcataaggactctgaaaactttggagttaaaataataaaatatccaacagaaggagtgctgtgcacttagccgtgcaatgggaagacttctattttggctctttcctttgacattgcttctgtgatcaaatccttaagcttctttccatttcagtgtttgcatctgaatattacaagaagcacatattacatccaattagccctacaggcatggattaataacaaaagataattatcattgattgtagctggattacatctttatttccagatttctcataagcagtgatataaatagacaagaaaggtgccatggcataaagaaagaaggctctgaaccagtccactagtgtgcagtggtttccaatggcttttaaacaataatgtaattcacttcacagtactgattgagtagacttgagtttatttcattatgataacactgttgttaggcattgtcatccagcttggtgacttcatacagctcaaggccaaacacatggtgtgcctgttcttgtaattcattcacacaattagtataaactaccatagatttagctttctaaagactacccatctactcctcttcccacctccactaccactgggaaaagctagagcaatccatgttaaagcttttgtcatgaagaattatgcacactgactgtgatgaaactaaaactacacatgcacatataagactacctaaaaagaaccatgctggaaaattcctttatcttgtttagctttgcaaaagctctgcaaaagctatttttctcaccatattcatttatggttttgcttttcctaaataaaagcatgtatgcagagcaggcacatgtgggtagcttgtttttactaatctttatttaacactaaatatctgatctgacgttctcatatactatcaaatgtggtaaccatatcattcagccaacatagtgtcccttttccccaggaactgccacagaatagtattcttctttacataattttttaaccatttaaaattgtaaaacccattctttgtttgcagactgtacaaaaacaggcaggtaatgggccagatttggcctacgaggcaaagtttgccaatccctaatctagatcagctcccagacttctctgcacgtagaatcacctagggaacattgtaaattttcagtgctcaggccataccccagaccaattaagtcacaatttcctgaggatactagcagcagtaattttggaagctcctcagtggaatccaaggtgcagacaaacttgagactcactgatctctaaactaagattttcttttcaagtgctgataatacatatcatttgctttgactttggcttcctttgtcattcctaatatccctagcaaaccatctcgggttagtagaagagtagatttcaaaataaaaaatcttggttatacaggcaacctacagaatgggagaaaatttttgcaatctacccatctgacagaggtctaatatccagaatctacaaggaacttaaacaaatttacaagaaaaaaacaaacaaccccatcaaaaagggggtgaaagatatgaacagacacttctcaaaagaagacatttatgcggccaacaaacatatggaaaaaaagctcatcatcactggtcattagagaaatgcaaatcaaaatcagaatgagataccatctcacaccagttagaatggcgatcattaaaaagtcaggaaacaacagatgctggagaggatgtggaggaatacgaacgcttttacactgctggtgggagtgtaaattagttcaaccattgtggaagacagtgtggcaattcctcaaggatctagaaccagaaataccacttgacccagcaatcccattactgggtatatacccagaggattataaatcattctactgtaaagacacacacacacacgtatgtttacagcactatttacaataccaaagacttggaaccaacccaaatgtccatcagtgatagactggattaagaaaatttggcacatatacaccatggaatactatgcagccataaaaaaggatgacttcatgtcctttgaagggacatggatgaagctggaaaccgtcatcttcagcaaactaacacaggaacagaaaaccaaacaccgcatgttctcactcataagtgggagttgaacaatgagaacacatggacgtagggaggggaacatcacacactggggactgtcaggggatggggggcaaggggagggagagcatgaggacaaatacctaatgcatgcagggctgaaaacctagatgacaggctgataggtgcagcaaaccaccatgccatggcacatgtatacctatgtaacaaacctgcacgttctgcacaggtatcccagaacttaaagtaaaataaaaaaacaaacagacaaacaaaaatgctaatgatcatctgaaaaaaaaatacaagtttctttcagagtggacagtcaaaaaaaaatcttggttataaagtaaattagtcatgcttgaaatatggtaggtggggatgatagcctatttgtcttagcctgggcatctccctaagaagccctccagaaagcaatctgagacaagtagttcatttggggacgtgctcccaggcagcaggaaagggagatgtagaagagcaaaataagaaatgaataagagcccatacaagcgtgtattatcaagctggtcaccatagtaggcaactgagtcttaatcccactgggatccactgaggacctatctagaacacacttcagaatagcctgcctgggaaatagaagagaggagcatttactcactggctcccatcccctacttgttaaagtctaccccagagattatttccctcatacttcccagttgtacatatttgagcaatgcagccaaccaagtggcaagctccaggtagccagggccacatgctgttaggtgacatgtgccaaaaaatggttgccacagcaatggctgaagaaaaggtaggctaagaggagagaggaggttcacaagagatatccaaaatgccatccaaaagtcattagaatccagtgttttagaaactcacatgggcagttcaataggcgactcaatatgggcttagtacaatgccaccttagataatgctatggactgaattttgttcccccaaaagttatatgtccccaatgtgatggtatttggagatggggcccttgagaagtaagtaggtttaggtgaggttatgagtgtgggaccctcatgagaggattagtgcctttttaagaagagacagcagagagatagctttcattctctctttccatgtaagaacacagcaagaaggtggctgtctacaagccaggaagagagccctcaccagaacccaaccatgctggcaacctgatctcagacttccaacctctagaactataaggaaataaatttcagcctttggtactttgttatggcagtccaagcagactaatacagataactcctctttcttcaaaacacagtgtcaacaatgatataccactcattttaacagtaaaaaaagtaaaagtcacacactttatcaaagttgaatttaaactcctctctaaatgttcctattagcactattctacttaattgtatcaagctgaagttcaatcagaaagtaagaacaatatataaaaaatacactcaaaatccttccacataaaaaataacttatgttaatattgtggcccattttctcccagccattgtctaagcattttattgcggttgaggtaactgcatgtttctacacatttctggatttgattggaatttcaagacctaattaaagttcgcttttgcccatagcagacacactgcctccctttgcccttcctaaatgtactctcttttactaactgccccttcacatatttcccggtgtcttgaacattctctcccccacaccaatcccttctaaagcctagataaacaacaacttcctaattatcttttcttcctgatccctcttatgtggctatttcactctccttttaaatcccattatcctttaaactttctttctgaattttatcattttattctaatcataggacatatacaagcactgtattataatgtctgtggactgtttcctcttcccattcctaattgtccacctttatattaatggattattgtttctgcaagggcagtatttgtcttactcatctctgtctttcccaccatgcctagtgcactgtcttgcccatagaaagaccttcataaatctgtgttgaattaatgaataaatgttaagattgtctcagctgtaagccatgcaccaccagtcttgacacttgttaactatatccaggcaaatattaaaaccctgagagatagaatatatgtgccattgtagataggaaaagccacagggtttctaaatgcatttcacttaagagtgttactgtgttaatatcacagtgtgtcatggatgccattaggaaaacgcattcagagcaatgctgccttcacgtctcttaacaaatgaactatttcactaagtataaggcctagcctacaagcgcactctccacagatttcaaataagcaagtgaggcaggccaaattactttcttctgccaccctccaacctcctatgggggcagtctttggtagaagccagacagcaagagaggctgggaggtaccgttcaaagaggtcagcctctctgaggcacagagtagggcagagaaatgcagagattgcttttggacagagggaatgcaaagagaataaagcatagttgataatggacttcacagcttctacagttgcatatgagctagatttttccacctgtacgagatgcctactgtggttagaccctattggtaaccatatagacctggaattatttacgtatccctcaattcaatagatggtcatactgatgctttacattgggtcacgactgtagacctgtaggacaccttccaatcatgcacctatttatttttcaatattacaaccatgtgatcctgaagccaaagcaacatcgtgacacatcctctttatcctgattgttcataacctgtcaggcaagaaagaatacatgagcatctgtgaaccaaagggttggccttagtttggagtgcagtaacttgctgtattataaattcagcatgctagttagctgtttatggctttgccatagctcttgcccaaagaggagtttctcctatttcattcctgagttttacaggttctagccattctatcaaacccactgtgaaagcccaaacacctacatatcatggtgtttgattttcctcttaactagcttctccacagaaccaatgtataatacttatttctgtccactgagctgatttccttgtcttcccatatgtgagagggcatcaattatgcggcgagtgtccactgccttccaatagcatgcactatgaagacacttggcttccccataagtaaactatgcctgctcttcctcttctacagccaaggttattttgaggggtatgagatttggaagacttcagtgcacttccatttacatacaatctggcacttttctggaggacagaaacttctgtggtgactgatttagccaattcttgtgagtgccatttcttcttggccgtggaagtcactggggcctggtcaaccttgtgtgaaggcaagtcctgcattgcctaacaggcaatattgccttcagactagaaatatacaactaaaaggttatggcacacctttagtattccttctcatagacacccgtggccagtaccatgctaacagctgtttctcaaaatctgagcttccaggatacattcaattcagaactctggagttactggtttggtctccctactggtttttccacaagctcaagtagactcgattgttaacctcttagaactcaaaagtcatggtgtatgcatatgtgtatcctactctaatttttctagagtagcacactgtgtttcactacctgtgcaaagttatttactttcaacaaagctcagtgacagcagccaggagtggcccaagtggggttgctatgctctccaggaccagaatcccaaatgttttatgatgaatagtgttaaggccatcaatttattccaattggcaatatttgtgttcttcctagccactgaatctcaaagaatgtaacagagctcgtcagccctcgaatctttttcactgcattttccattctctgcactgtatgtggtccaccactgtgattacggtatatggcaccattatctccatctctccactaattaggaattgatggatatggtagcggtcttacctaatagagagtaatgtgcccactaagtctcaaagaatgctttgcccttaggaggcaaattttcataaccctgtggcaatatcattaaagtatattgcaaactttcccaattaaaggtcaggtgaggctagctgtcctcaatctttgagatagagaaaatgacatttgccatgtacacaggcctaagtgacctggttgttgactatgatcatgatgttcctgcaactaacaacatttcatagtagaaggtaagaattgcaatacgtcctttattccccaatttgtggatctatttgctaaaatcagcccatttagctttcttaaattggggctaatgaattttaagccagtaactcctaggtagagagaggaatgcatattttaaaagttttctttgaatattggtgtctttgccacaagaactacagcaaattgctggttttataaattttaaaaagtgtttgaacattgacaattacatgtggttcaactatgctccaccacaggaaactgactaccctacttgcagagaagtattacaagaatggatttgttcctgagaaaaagtaagaattaatgtgatgggtcttgttcctggccccaggttttaaatgctttatgcatttccttcaaaaaagttaaatgttggaaaagggagttactattaatagaattttaaagaagtaaatacagatgatcaccacaagctacatacaggcatacttcagagatattgcaggtttggttgtagaccaccacgataaaatgaataacacaaccaagcaagtcacatggatttttcggtttcccagtacatataaaagttttgtttacactattctgtagtctattacgtgtgaaatagccttctgtctaaaaaaaaaaaactacatacctgaatttaaaaatactttgctaaaaatgctaacgattatctgagccttcagcaattcatactctttgctggtggagggtcttgtctcgatgttgatggctacttactgatcaggatggtggttgctgaatgttgaggtggctgtggcaattccttgaaataaggcaacagtgaagtttgccacatcgattgacctttcccttcgtgagggatttctctgtagtacgtgatgctgttgaacagcaatttacacacagtaaaacttctttcaaaattgtactcaatcctctcaaattctgctgatgccttaccaactaactttatataatcttacaaatcctttgttatcatttcaacaaagttcacagcatctttaccaggtgtataacccatgtcaagaaaccactttctttcctcatccataagaaggaattcctcatcagttcaagtttgatcatgagattgcagcaattcagccacatcttcaggctccaggtctaattccagttctcttgctatttccatcacatctgcagtgacttcctccactgaagtcttgaacccctcaaagtcatccatgagggctggaatcaacttcttccaaactcctgttagtattgatatttttacctcctcccgtgtgtcacaaatgttcttaagaacatctagaatggtgaatcctttccagaaggttttcaatttactttgcccaaatccattggaagaataattatctatggcagccatagccctgcaagatgtatctcttaaataataaggcttgaaagtcaaaatgactctttgatccgtaggctgcagaaaggatgctatattagcaggcacaaaaacagcattaatctcctcatatatctccatcagagctcttgggtgacttggtacattgtcaataagcagtaatattttgaatggaatcttttttttttctgagcagtaggtctcaacagtgagcttaagatattcattaaaccatgttgtaaatagatgtgctgtcactcaggctttgttgttcaatgtatagagcacaggaagagcagatttagcataattcttaagggccccaggactctcagaatgatcaatgaccactggcttcaactaaaaaggcattaactgcattagcccttaataagacagtcaggctgtcctttggacctttgaggccagacattgacttctcttctctaattatgaaagtcctagatggcatcttctaatagaaggctgttttgtctacattgataatgtgtcgtttagtgtagccaccttcatcaatgagctagatcttctgcagcagcttctacatcttgtactttcatgttatggggatgacctctttccttaaacctcagaaaccaacctctgctagcctcaaacttttcttctgcagtttcctcacctctcttagccttcataattgaagacacatagggaccttgctctggattaggctttagcttaagggaatgtaatggctggtttgatcttctatccagagcactcaaactttcttcgtattagcagtaatgctgtttcacttttttattatgtgtgtgttcacagaagtaagtctgttaatttctttcaataatttttccttgcatttataacctggctaactggtgcaagaggcctagtttttggcctgtctcagctttcaacatgccttcttcactaagcttaatcatttctaactttttatttcaagtgagagaggtgcgactctttctttcacttgaacatttaaaggccattgtaaggttattaataggcccaatttcaatattgttgtctctcagggagacatgaggaaaggaagaaagacaggagaatggcttgttggtagatcagtcagagcaaacacaacatttattgattaagtttgctgtcttatatgggcactgctcatggtgccctaaaacaattaacgacagtaacataaaaggtcatggataacagatcaccctaaaagagataataattatgaaaaaatctgaaatattctgagaattaccaaaatatgacacaggcacacaaagtgagcacaagctgttggaaaaatggtgccaacagagttgtttgatggagggttgccacaaaccttcaatttgtaaaaaataaaaacaaatgtagtatcttcaaagtgcaataaagtggagtacaataaaatgggatatgcctgtattagttaaaaaaggatattaaactcatggccaggcgtggtggctcacagctgtaatcccagcactttgggaggccaaggcgggtggatcacctgaggtcgggagttcgagaccagcctgaccaacatggagaaactccatctctactaaaaatacaaaattagccgggtgtggtggcgcatgtctgtaatcccagctactcgggaggctgaggcaggagaattgcttgaatccgggaggcggaggttacagtgaaccgagatcacgccaatgcactccagcctgggcaacaaaagtgaaactctgtctcaaaaaaaaaaaaaaaaaggatattaaactcataactaaattttgtagcattaatttggtcattctataatagattaagatgtcttataaaatatgtattttggctttagaaaatagttgaaaataacatcatgctacattacattcaagtgtatccgttcaattcagcctatatgttcctcactatacaagtaattttaataattttgattttgtatgcctttaaatcggtcatgtacttttcagttacccatagtccctaccactccctattgctttatacgtagccacttcgcatatttggtacctgcatgacatatgaaggcatttgaatgttaaatttctgctattcataatgacacacaaattatgtaggaactattcacttgtcagccaaggaaaatatgaagaggtgtttttctttaaacagtgagctcctccactgcattaaaaatgaatccaacttgaaaataatttgttttgtgctgaattttttagaaacacgacgtgtatgaagttaaatacttgaaaagattatcaagaaaataaagaaatttgaaagtgagaactgatgtgatgtcaaaaaaacactcaaagacaaaagcatttagaaagtaagtttccttgcaacaaaatacaggcgagtcagacttcaaaaggaatggtttgaaaaatgtgtgcgtgtttaatgggaaaaaaagtaagactgccatcagtctgctcatggtagaaaaacagcaactttctaatgtgattatcaaatccacaaaggttgtaccattttttcagacatcagcattgccaaagtcacagctaaaggtgctttagccagatgagtccaggcatacaggaaatgtgcaaggtgccatccaatgtaagatcagaactagagaactagatggggtggccttattattttttactaattgtggagtacagagtggtttttccccctaacggcaaaacatgatctatacctgtattagcccattttcacactgctataaagaacttcctgagactgagtaatttataaaggaaagaggtttaattgactcagttccccatggctggggaggcctcaggaaacttacaatcatgtcaaaaggggaagcagacacgacttacatggcagcaggcaagaagaaactagcatttataaaaccaccagatctcatgagaattcactcactatcacgagaacagcatggggcccagctctgttgctaacaagctgctggtgctcaacagtcttcttattctccgcttgttccggagcaccacctctggactacattcctcagcctccattgtaggaccacattcctgtgactgaggtctggaatggaagtgatgtgtgccatttctaggcctggcccatcaaaatctgccatttgtagttcttcatgttttttccccatccgctacctatgagtaaaggaatctgaggactcagaggagggtgaaggcacaagagggaaaggagaagcaaccttgaataactgcatggaacaaaactctatttcccattctccccatccctgctaacctacacaggattgaatgtgttcaaggtagaaattctaaaaccacagatatattgcagttgtttattacagctattggtctacatgaataaatataccgtgtgacagtgttagttactagaacttctctaaactcagtatcttcatcagtaaactgagaataacaatgcacctaattgaggggattggtgtgacatttaataagaaaatgtacaacactgagcacaatgcttggcacacagtgaacaatcaataaataccatctactaaaatggttcagtgtgtgttagctattacaatattagatgagttggaaaaaaagaaaacggaatcatttcttttgcttggtaatatatctctatacttggacacatagagaacccagtccttctagttaaccagtgctaataccatgtatactgattaagtactcctttgaagatctggagtcctacagagctgggattaatgttaagctggataagtcactattacaacagctgcttgaaccactggagtgtacccaatcgctctccaaattgaaaactctgaggaatcactattaggcattatatccccaagcataacaactcccataagtttcagaacaccatggagtcaatagaagaacagcctactcagagactgcaccaactgaagaagatcctgcctctgctgtcaacatcaattacagtgtattaaggtcccacagggtgcagtgcttaataaatggccttacttaatagatgttaactaattacacctagaaaattcccatccacccaaggaaagtattgtaatatgccagatgagaaagaccagatttctcagttagatccttcaaatgcctccatgtctcctcaaggtagaatatgaaagcaaaagaagctttttccttccctaaagtctgccctattctaatacctaagtcaggcacctgtacaccttgactctggacataatcactttatcaccaggatctaaaaatgattttcagagaatggaaatcaggtcaaattcctaaaatggaagagtagaaggtcagcccccaacctgagccagttctcttcatctagcctctcaggtaatgatggctggtcactgcagctaaaatgcaaaacacaaaagaagaccttttactttaacccaggtgtctgcttatcatagtgtagaatacaggagaacatttttaaattggcaggcagttggcagggtcaggtatttttgtttgtttttgtttttgttttgagatggagtcttgctctgtcaaccaggctggagtgcagtggcacgatctcggctaactgcaacctctgcctccagggttcaagccattctcctacctcagcctccccagtagctgggattacaggtgcacaccaccacgcacagctaattcttgtatttttagtagagacggggtttcaccatgttggctaggctggtctcgaactcctgactcctgatccacccaccttggcctcccaaagtgctgggattacaggcgtgagtcactgtgcctagcctttttttttttttttgagaacttgatgaaagttaggaatcctatctcaaaacacacacacacacacacacacacacacacacacacacatacaaaaactgcatttcaaatttatagaccctcccattgtaactctggaacagtagctttcatgcttcagagtgcatgaaaacccccctggagggcttcttaaagcacaggcccccagagtttctgattccattagtctgggtgacttgggcctgagaacttgcacttctaacaggttctgatgatgctgatgctgctgtgtctgggaaccactccctgagagctgccactctaggactctatggaccaggttgaaagtatctgctccaaggagtccacttcggagcatttcaaatgctgggaacaggggcccatcaatatgtcatagggcagaagacaaagatcctaactctcagcaacactgagctctgatctgtgaccttcagcaaattctcacctatagcttgtgaaatcctcctggtcttttcctctgattcctgcttctctccccacccctcagcctccgcctttctttattcctttctgtctcaggacctccatgtttatgcatcgctctccttccccatctgtttctgtgtgcatatgtatgggtaactagatgcctgagctcacctctgtccctctcttattgtccccaatctctttccctctgtacactataataggaaactgtatttgcatttacaatttgttgtagctattcaattaagttttatgactcatattcttaattttgaagcaggtaaatgggatattttatatttgtctctaaggatataaaatactaaagcctcttaatatttttcctaggataactcacatcttggttaacagaggaaaatattcccatgttttttttttttaatacaagcactatgtaatagaactttctataacgacaaacatgttttgattctgcactgttcaactcagcagtagctactggccacgtgtggctactgagcacttaaaatacagctataatgactgaggaagtgagttttttatcttaagtagttttaaatttaaatagccacatgtgcctagtggctacagtagtgaacagtgcagctctatattgtctaccttgaacatttatatactgtatacatacaggatgcagaaacctttcaaaatctctcaagctatgcttggtcacctcaacatcaaaacagaaatgcatccatcccctaaacctctcatgaatcccatgttacataaacaaggagttatgtttttaacttaaaataataataataataataataataataataatgtaattgtaaagaaagccatgtcaaacactgaagagatttttctcccagtcacctaggagctgaaaacctcctctccagggaggaacataaccatctgtgtgcatcagttggaccagcactgtttgctccacttgaacagggactggaaagcaacagcatgaacatccaaatcattcattagcagacacccagaatcccaccggtaaataacccagcatcaagtcttgctgcagtctccaaagtatctcaactcctgttttggtgattactttggctctcaagaaatctcaaaaattctacaaatctctccaatcaaaattactttaaacttactttaatttacagacacatgccatgtagccccttttcaaagctactatgggaaagtaagtgaactgatagggcgtaataatttcaaagggatcatggaatcactgttcagcctccattttaaaacttctctcatgttacagactcagattcttcatcaaacatcttcaaatcttcctatccctagggttttgagctaagaaaatataaaaattaagaattaagttttcttttctttttctttttttttttttgagatggagtcttgctctgtagcccaggctggagtgcaagggcacgaactcagctcactgcaacctccacctccctggttcaagtgattctcctgtctcagcctcctgagtagctgggattacaggcgcccgccaccacgcctggctaatttttgtatttttggtagagatggggtttctccatgttggtcaggctggtctcgaactcctgacctcgtgatccacccgcctcggcctcccaaagtgctgggattacaggcgtgagccatcacacccggccctaaaaattaagtcttgttagagactacatctgcccgtgaagaccttgaaatctgtgctatggaaatggaaaacaaatcagatttcactatctttaattgttgtccattaattcggtcctcaccaaggattcacaccattgaccaaagttccttaggagaaatctgagttttcctagggcctaacataacatctgtattggttataaggcattatatctgtatggcacttaagaacttattaattgccttcgtttacactgacctccaatcctcaccacattgggaagtggatgttacagcctcacttttacagatgaggatatttaggagcagagggtctaattgataaggaaatgatcaattgaaacagacatgcaggtagaaaagaaatctaaattgcagagaagtaggtttgggtcacaaggctagaaaataatatcgaactctccactatcttaaatttagtacataatacgttttgagaagcaaaattgccatttcacattgaattaaccacgtggaacttagcccaggctgtcccaaggcagattaataaaaactgaatttgtgagagtgcctttgaaccttcttgaagtacatgtaatcgtatgtgaggcttttacagatgcattttgtttctgaatcaaggattggcacattgtaagagcttgatataatgacaggagtctttccgctgaaaccagtcagaagccaaaaacctcataaatgtttaccataataaatcaccttaatatatctcactttgctaagttgttacccaattagtgtaatgtaagccaagtctgtggtaggagctatctgaactcagtgtaaacctattaaagaaatttacttacccctgaattgacctgttttgaacactgagccatattttcagggacagattaagaaacagattctagcctgaatatagaagacttttttcctttaaataaaatctatatgtggagcatagaacttttacagcctttatttgaagttccaacatgaagtgatattctgttgaacacttttcgggtagctatggcaacaatgattatcaccacatactaccaaccaaaataccacctgcatccacgtctattctagaccgttaattaacaagaaaagcccagttcaaattcccagttggtaaatttggcagaaaacttttttcaaaatgttgggaaatctatttagctttggcttctgtgtttgcttcacagagttttgttgttgttgttgttatctttcagaacaacttaagtctgactctctctcttcctgctcacaccagaaccacccacacacactgttaagtttcgggagaaatagaggtttcggcatttccttttctaaggagttaatcagtaataagatctccaggggccccccagagtactcctttcaaacaattatccatgtacatgagaatttcaggcttgtttttagtttctctgtaggaaggaggggagatagaaggggaacagaaacaggaggtaaagactgaagagaaaggaagctagaaaaagaaaacatagaaggaaaacgagcgaagaaacgtagaaaagaaagaaaatgagcccaggatcaaaaaagaagagaacaatttatttcaatctgtgaggaagaaggcaaaggggaaaacatgcagaatccatggaaagcagaaacaggcttcacacaggcttacaatggaagattctgcaattgactaattgcaggaactgctccagttcgtcactgctccctatttcaatgccctctatcttgtaactttgaagtgcccacccactccaactttggactcagccacgaacttgctttggccaatgggatattagcaaatgtgatgcaaccagatgcttgacaagtgcttgtgagagtagacttgcttgctctcgccctttaccactgctatgagaacatgcttggagaatgaaagacacattctgagctgagctgaggtgctcctatcttcccagccaacgccatctcagatcagctgacagctagcatacccagagatgtgtgagcccagccagtatcaggaaagttgcctgtgtcaactagcagctgagtgcagacacaggcgtgagccctgcccagatcagctaaataaatgcacattgttgtaagccacctaggaggtttgcgatgcagcattactgtggcaatacataaccaatataagtatataccctgataatcaaggagctcattctatccccattatattaatgatttctaccacgtaatcttgtaactaagtatcaaaactccataggaaaatacaatgtagaataatcttaaaataaatacagtcaatgcaaatttttggacatgataggtgttattaaccaacaaagtaaaaaaacccaggatattccccaaggtaaggtcattgagattctaaaaccacagaaaacttggaaaaaagccagccaatcctactttaggataaattcaatttaggtaattacaaggacacagcaaactttgtccacagtcactaacactgcagcaagtaacggactaaaaagtttgcaaattctcaggtgccctatcaattgcagctgaagagctataacaataaaagcgttttctccagctgtgggcctgagggtaaacagggtaggtgatccctgatgaatctgtgctgccaactgcaagaacagagggtaacagctgctatcaacaccacactccctagcttaccataaaagtaacaaatgaattgtcatttaaacaacaacaaaaaaataccttgaacacatatgggcaagagcactgcattcaccttctgtaaactgaactacacaaagaaaaacatgactggaaagtggacgatacaagcaattagaatagaaaggtttctttgcctgtaaagctgagttacattttctttccaatgagaagtgctcggggggaattcttagagggtcactggtaaagggatacctgtgtactaagtgaatgagacaatattctctgaatctcaaatcatatgtttaatcaaagaccctgttaggtatgcggctgagtaaatagagtagtaacatattgacaaaaaatggatttttaattgacttcagtaatcagggaacagtggcgtgaacaatctctgaattattttattatgatcttggaaggcgttttttcattgacaataactagaaagggaaaaagaaacaccttggcagaatctgaaggatttctagttttgtattctgatcattatccaactcacgtgtggtacccacggcatggcaaaaattgccagtctctctcctcagcaactggaaccccactctgtctcacaccttccttgggtggatggcagagtaaggataaggtaactattgtgtttacaataccttttctaatgtgtgaggggtaagaagacagctgactctggttccttgaatcttttccttctttcctgtttttaatggtttccagatgccaggaagatagttcagagatgagggaatcagaggaatccagtgaaaagcagtgatacttcaagccccttgagatttgttcatccatccatccatccatccatccacccatccatccatccaacaaactcaatgcaaatattggatgcctactatgtgcctgctatgtgttaagcgctgtggaaacactgatgcacaaagaaaaacagtgagagagatacatgagagatataagagagatacatatacgtccttacaatacaacactagggtgccacagtggagagtgtaggagtgccgtggtagccgtggggaaggactgaccaaatatacctgaggagtggagctggggaggcatcatggtggaaaagaagctgggctccttcttagacagtccccaacaaaatcagccagacaatggaaagtttacttcacaatgatattttaagggggtcttgtctcagaagtgcaaccaacaaacccttatcatcctcgagcctccattaataggctctaaaatctcaaactctaaagtttaggaatatagatgtatgtgaattaatacaaaagtctgaacgccttagcatgaaaaattcctacaactacgtgggcctggaatatttgtggaacaccttattagattccagaaactgcactaggcatgctgtcttatttgtttaaaagaggggcaaaggcttggttatagttctttaatgcatgtgaaatctctgagatatacaccgatagatttggcagactttccatatctacttacacaatgaaatgtactttggatttaggtttttctctctaaaaataagatactgttttaatttgaaaagtatatgttagtaaagacaacaaaatatgtttttttccactaaaattgtcactttaaggatgttatgttatactgagagatctaatcagaaagccttttaacacaagtatattttttcccccacatgaataaattttactttttgtccttgagaagaaaggccaagaaaacttaccactgattaaggagaggggactcaaatacattgcattttcttaaataagtcccttggatttatgggctggttccattacggagccaaggtagtgcattgtgtcattatcacctgacttctgcttcttcactttatagagagttaattcaaagacgactactgaaaagaagccaatgaaacaatttcaaaagcatttccaaaacttactctggattgtaaacaaatataagccaacaaaaaattaaaaggccatgctttgcagtctggagaccataatttacagtgtttataagatttttctgcttcaaagttcaaaatgaagagtagtcaatttatgaacctcatttaatcctttgaataaccccatgaagtaggaattatcactattttacaagtgaggagaatgaggctcagaaaggtttaagagaaggttgtaagtgaagcagccaagactgaactgtaggactgatggacttcaaaagccattgttttaccattaaaacacattacctgttgatataatttcattgtctgtccgctccaaatctcatgttgaaatctaatccccaatgttggaggtgaggcccgctgggaagcgattggatcatggggattgatatggtttggccgttccccatccaaatctcatctttaactgtagctcctataatccctatgtgttgtgggagggacctgctgggaggtaattgaatcattcagggtgggttttgctgtgctgttctcgtgatagtgagtaagtctcacgagatctgatggttttattaaggagagttgccctgcacacactctcctgcctgcgccattgaagacatgcctttgttgctccttcgccttccgccatgattgtgaggcctccccaggcatgtggaacggtgaatccatcaaacctcgttcgtttataaatgacccaggcttgggtatgtccttttagcagcatgaaaacggacgaatacagggctgcatccctcatagatggcttaccaccatccccatggtaatgagtacattctcactgtaagttcacacaagatctggttgttttaaaagagtatggcacttcctcttgtctctctcttgcccccactcttgccatgtgacatgctggctcgtccttgccttctgccatgattgtaagctccctgaaaccctcaccaggagcagatgctggcaccatgcttcttgtaatgtctgcagaactatgaaccaattaaacgtcttttctttatagattacccagcctcaggtatttccttatagcaacgcaagaacggcctaacacgtctgtgattaaacccttttctgtttgatttgactattaaaatactacattctgttgatgctatggaactagctaaaagactgctgaatctggagtttggtaaaactaaaaaatgacagatttattaattaacttcactactgtttgaggagttaacaataccaatcataagagaaaaaaatggagcaagctcatcctctcgttgggctccattcaagtgtcaagacagggaaggataaaatattaaaccaaaatgagaagaaaaaaacaaaaaaatagatttcgtatgattggagaaaacttaattacagatacatatggccctttaagagaaggcaacagttaaatcttctgtttcattttgtttcctctttctcccagaaaggatgtttgggccagaaatataatacttttataattttaaagcactttacagcatgttttcacatagattattgcatttgatcttcacacctactctatgaagtgagatttatcagtgttcccatttgatgtatggggacactgagttcagagcagctacacaacttactgaagcatgtaaactgtgcttgacacagcactcaatgccaagttttctgatctgaagtccttctttccgacaaaacactgcttctccttcctgctttgagccaaagagaaacaacataaaaaagagatgagaaacaaagaaaatcatataaattataagacaaatcacatataagctgagttcagctcacgtccaaaagcatttggcattaaattagcattcaagctaatttctaaaatataagtctcctatcagagtctatgtatacaatcataatttaaaaaaataaggcatttgggggttaaaaatcaagtgggaaaaatatttcatttcatcttataatacaccttatactttaaactccattttctgcttctacattgtttggtatttgatttaataaactattaggcctgtagcagattctcagtaagtgtgtccactgagaatttttagcatgaaaaggcccgcatatgaattttatcattatatttaagcaaacatggatctatactatcaaattttgctgatttgttttaaaatggtggaataaaatgctggaatcttggctcagcttttacagagtgaaccaatattcatcttgcatatgttgattgatgtctcatgtttccctagaatgtataaaaacaaactgtgctctgatcaccttgggcacaggtcgccaggacctcctgaggttgtgtcacaggcaagcgtcctcaaccttggcaaaataaacgttctaaattaactgagacctgtctcagattttctggtttcacatttcggtaaccatggagggattctgagtggagatgcccctgacctttgacctatcagtgctgggtaccggcatgagctaactttatggctcaaaccaataggacaatttgctgaggtctgagagcaccccctccagagaatccctgatctccaaacatttggatgagatataaagtttattttgctgtacaactccactttttttggagttgtacttgcttccaacaaggaaggcaagacttcctgtttccatgtcgatggaagacaggtaattcctttatggagtttgagctcacttccaacacggaagatgagatttttttttttttttcatgctgctgggttggtagagagcagtctacagcctgagacccatccctaggtaagtaactgaattgaggtttgtcttggctaaagttaagactaacaaccagctggtcttaatttctcattaccatcagagtgctcagtaatcatataagttgtgcgattgtttgttttgcttaactggtttttttgttgttgtttatttctgtttctgtcgttgttttggtctttttcccattaggtttgaccgactctattcgacgtgatcaaatccgaaggaaagttccaagttatggggaacaaggcctttaaaggggctaaattcacacacacacacacacaaaagtgatgtggcgggggggagaaaaacaaccagcaaaaggaaaaaaacatggattttttatttggactacttaaagggctttatttacataacaaggccaccgttttgctagcgaggccaaactgaaagagcaatggctgtcaccccatgctgcaatttgacagctaagctccttgcttttttttttttttttaaccacgacagcctggatttggttcataaatcaaggccttcctggtttgatacttggtacttctgaaatggcagaaatttctcctagctaaaatatggcaatgaaatttaaaaggattttttttaaaggagatcaatggttaaaagtcagcttaattaaaaggctaacatccaagatgtgtgtgtgtatgtgtgcatgtctgcatgtttgcatttaaaaggctttcatgtttttctttgttgtttttctctcctaggaccttgtctttttttttttttttttgagcaaaagttttttttcttctcagttgactgaattctcttttcgcctgatttttatttatttatttatttatttatttatttatttatttatttatttttgagacagagtctcgctctgtcacccaggctggagtgcactggcgtgatctcggctcactgaaagctccgcctcccgggttcacgccattctcctgcctcagcttcctgagtagctgggactacaggcgcccgccaccacgcctggctaattttttgtattttttagtagagccggggtttcaccgtgttagccaggatggtctcgatctcctgacctcgtgatccgcccacctcggcctcccaaagtgctgggattacaggtgtgagccacggtgtccggcctgattttttaattaaaatagttattgcaacagaagctactgtttgtaaggaagagtgtagtttggaaacttaaaaatatctgtttaaaaaaattttgaagtgcactgtaaaagcatcacatggtctagtcttataattctctctttttggagacccaggattcagtgtgagctctgcccagagcttagagatgcagttaaaaaaaaaaaaaaaaataggtagtccctatctaaataaaattggtctccttatacaatcctataataaatttctgtaattttatgcttgatttggcatccatctttaatctccctctagcatcaccaaactttttctctctgtaccctgagatgtaaattttgctatctgatttttcatctaagagttatttcttttaatatgcaaatttaaggctatttagctgacaactgccttgggtaagatagggaaaaaaaaggaaaaaaaggaggcctttatgaatctataagatgtacttctatcggcatgcctaacacgtctatgtatttatgtgttgtgtacacagtgtttcactactaaaaatatataagagctctaattaattggctttaaaaaaataaaagtgcttaagccagatactaaaaaaaagactagtcaaatgcttttcaagttcacgtgacttaagtaaactctttaataaataagctggcttttaaaatatttagtaaaataacattagaaatgtcttaagaatttgccaacagacatttttgtttgcatttattaatcaagcaatttcatacttatccctgacaagtactacaaggtgtcaaaatttggcatggggggttacaaaactataaacccgaggcgggcggatcacctgaggttgggagttcgagaccagcctgaccaacatggagaaaccccgtctctactaaaaatacaaaattagccgagcatggtggcacatgcctgtaatcccagctactcaggaggctgaggcaggagaattgcttgaacctgggaggcagaggttgcagtgagccgagatcacaccattgtactccagcctgggcagcaagagcaaaactctgtctcaaaaaccaaaccaaacaaaacaaaaaacaaaactatgaacccagcccaaaacagaatgatctttgcttgtgtaatctttaataagtaagacattgatattggtttaataaaaatagctacaccttaaatttagtaagattaccataactttaatcttgtggctttaggtggtctagtccacaggcagtaaggcttgttattgcctttgtttcaaagctaaactataaacgaagttcctcccaaagttagttcagcctatgcccaggaatgaacaaggacatctgggaggttaaaagcaagatggagtcagtcacatcaaatctttttcactgtctcagttataattttgcaatggcagtttcataatgttaaatcatgactattgcagttttcgtaaataatctaggtaaacaattaaaataaaataattcggtaaatgtaatgtgataaatacttgtggactaccttgtcataatttagaatataaagttatattaaattagataatagatatttcattatttgggtattttcaaataaaaatatattgtagaaaaacattctttcttaaaaaagtgtcctttttaaaagggtgaaaaatttttgtctaattcaaaggttatttaaacgttatgtataaaacaaggtaaaaggaaccaggaaataagagaaatgtaaagaaagttacagaaataaagaggtttttttggtaagaaagcttaaagggaaataattttatatgagaaagaatcttatatggtaaatttagacctagaataaaatgactggttgtttaagaaagagggacgttcaggaaaaaccagaaagttcaagcatgtcatgaatggtctaagtcagtcacaataaatggattgatatatttttaaaaacttatatagttaagttgactataattaaagagaaatgataatggtctttctagagattgtgtttgatgtttaaaaacacttatacactaaataattggttagaacaatgaaattttcttaagggattgattgactcttaatatattataaaagattttaattttttttaacccaaagttcaacttttattgcatctctacgtttttggttttctctccccttttaaagggcacaaaatagtaatgctctccttaaacttatcttcagcttatataagttttttttcctggagttctgttgcagtggcccaatgctagcaatgttttcttaaaggtctaaaggaaatgttttcttccaacataatattctgtgcagtgcagcaggtcttttctcttgccttttggtaactggcctaacagattttacattttatcaaaacaattcatatatcattattattaagtttttgtttgcttagaaataactgatattaaaaaatttaactaaggttattacatccatgtatctttctgtatgtgcttttaaagtccttgtgacgagggaggagccaagatggccgaataggaacagctccggtctacagctcccagcgtgagcgacgcagaagacgggtgatttctgcatttccatctgaggtaccgggctcatctcactagggagagccagacagtgggcacaggccagtgtgtgcgcgcaccgtgcgcgagccgaagcagggcgaggcattgcctcacctgggaagcgcaagggtcagggagttccctttccgagtcaaagaaaggggtgacagacgcacctggaaaatcgggtcactcccacccgaatattgcgcttttcagaccggcttaaaaaacggcgcaccaggagactatatcccacacctggctcagagggtcctacgcccacggaatctcgctgattgctggcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctctattgggtccttgacccctgacccccgagcagcctaactgggagacaccccccagcaggggcacactgacacctcacacggcagggtattccaacagacctgcagctgagggtcctgtctcttagaaggaaaactaacaaccagaaaggacatctaacagaaaacccacctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgggatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgactggtgtacctgaaagtgatgtggagaatggaaccacgttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagacaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaacaccaggcctgccctaaaagagctcctgaaggaagcgctaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaaccttaaatataaatggactaaattctgcaattaaaagacacagactggcaagttggataaagagtcaagacccatcagtgtgctgtattcaggaaacccatctcacgtgcagagacacacataggctcaaaataaaaggatggagaaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaacacaggagcacccagattcataaagcaagtcctcagtgacctacaaagagacttacactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcatgcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggtttcttgaaaggatcaacaaaattgatagaccgctagcaagactaataaagaaaaaaagagagaagaatcaaatagactcaataaaaaatgataaaggggatatcaccaccgatcccacagaaatacaaactaccatcagagaatactacaaacacctctacgcaaataaactagaaaatctagaagaaatggatacattcctcgacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgactgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccagaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcgtatctacaactatctgatctttgacaaacttgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacaaggacacaggaaggggaatatcacactctggggacggtggtggggtcgggggaggggggagggatagcagtgggagatatacctaatgatagatgacacgttggtgggtgcagcgcaccagcatggcacatgtatacatatgtaactaacctgcacaatgtgcacatgtaccctaaaacttaaagtataataaaaaataaaaaataaaaaaaaaaaaataaaaaaaaaaaaaataaagtccttgtgacattgagttacagggctttcattcctgagttctaaaaaaggacatcaagtcctgccaaatcttaaacactgacagcaattaaagctgcatcttcaggccccataaaagataccagtcagaataaactacattcctaagacacagggccagaaattaaagctactcaactcctcaaggcccaagaactatcgcagaagaggtaggtgcatgagattgtgagggccagttttttaaagataaaataggttcggtttctctataagttaatcgtgaatgtcaaaggcacactgatgtaagaccagcatataagcccctgtgtcagattaacaagatttttcttgaagcattaactgactgcttaataaaggctataaagtttataaaatccttatggaagttatatcttatggtcaagattaaaattttataggttgtttataaaattttcaaaaacaaatttaaatggtttcatgctgtttttattagggcttattgtttggaaaattaaatctcttctctcaaaaaatgaaggttttcaccttttctgaaatccttgagttatcactttggttaaatgaatgacttattttacaatgaatgacctgtgatcctattttgtgatatcaagtgttttaaacctttgatatttgacaaactttccaaaaatcaaattatgaattatgtctttttctgacctaattaatcctttaagatgttaggttcccaaaagtctaaaaatgcaataatttggcttatttggtataaaaattatacaggaagcattgtcaaatgtgaaatggtgtttgtttttctttaggctgtatttgtataaataagttattggtatgtgttccaaaatcatgggaaactcctataattctgatatgacttaatgtacattatcagtaataattataattattatgttaaattattgtgtgccacaaaggtaacaaatttccttgtcaattgtgtcatctttaactatggctatcctaaaaccttttgtcatccacagacaattgttgtcttgttttggtcttccttagaaggtggttttataatcaggtatagaactctaacaggtgttcttaaatacaggtttctgatcactttggagattgtaacattagaatagaggaaaaagctttcaggactctcatggagagctgaaatgttcatgaatatcaagcagaacaggaagtaactgcgtaaaccaaactgatagaagactaaagtaatcttttttaactttttgcttaaaacgttgctgatcctttgttttgtttttcagagtcaagaaaacttttcttttaacctatttataacttcagcaattgagtaaaatacactcctatgaacaaaatttggagcatatttgtttctctctacctgatttctccagaatttggaaactattatttgtgggtattcttaacttacaacaatacagttatttgcataagtgcaataagaatttcatttgtaacagaacacagttggagaaactggttattttgccaagactttaataaatcaaacttgacttatgcagccaataaaagccctgtggttaaaactggcctcatcctttgtttacacagtccctgtacagggttcctgacctgtggtaagtaaagaatgtcactttctaacaggcccaggagccccaagtttatgttggaacctcaagagcagaggatcactcaactcgtaggtatttgatggcacaaacttatggctgggctcgactttaaaaaagtcttatctgagattcctcctatgaaacacaattccattgaagccaattgaaaagcctatgtaaaaaaatagttattcttgctgcactttatacaaattattaggccaagtataataaagcaaaccagtccagccgtgatttgtctttggtaaaaatggaaaacgggagagaaaaattgtatttcaaaactatagcacacctgttgttagattttagtcttgcctaatgtttttcaatttttattattgtctacagtttgggctgaattctaatttttcctagctataagtcttaaaaataatattttcctttttttcttatttattttcctttttcccattttttcctaatgtgaaatcactgaaaaataagctgtacttgtgtaaagccctgcgaactgaagctagacaacctaaacttcagaagcagataacagcaacctatttacaaacataagccactgtctttcttttctttttttttttgagagggaatctcactctgttgcccaggctggagtgcagtggcgcgatcttggctcactgcaacctccgacttccggttccaagcgattctcctgcctcagcctctctacaggtgcatgccaccacgcccagctaatttttgtattttcagtagagccaaggttttaccatattgtccaggctggtctcgatctcctgaccttgtgatccacccgcctcagcctcccaaagtgctgggattacaggcgtgagccacggggtctggccataagccactttcatacctgctaactgatgtatggactccagagtaatgtggcctataccaattttccaggattgttcttttgtttgttgttgtttttctcccttcctccccctactttctcttcataggacatgagactttacaacctgctaaaaatgagctttcctaataacttgggacctgccaatctaggaataaaccatcccaatcatgaaagatcaaacgaaacctgataccagagactcattttcttctaaaatgcttctcaaaaaagtttttgaaaagagaagggagtaaatgtgaaaggagaagaagtcatggagcccccaaatcactaagctaaagggaaaagtcaagctgggaactgcatagggcccacctgcctcccattctattcaaagccacccctctgctcactgagataaatgcacatccaattgcctcctttggagaggttaatcagaaactcagatgaatgcaaccatttgtctctcatctacctatgacctggaagacccctccctgctttgcttcgagttttcttgcctttacagactgaaccaatattcatctcgtatatgttgtctaatgtctcatgtctccctagaatgcataaaaccaaactgtgccctgaccaccttggacacatgttgtcaggacacataacctcctgaagttgtgtcaagggcacacatcttaaaccttggcaaaataaactttctaaattaactgagccctgtttcagattttcagtgttcacatcatccatcaaatggggacattaataaattccacttcatggagtagttgtaaagattaaatgcagtaatctatgtgaaaatacgctgtaaagtgctttaaaattataaaagtattatatttctgccccaaaaattatttccgggagaaagaggaaataaacaaaacaaaacttaggcaaaaatttccatagtttagaattctataacaccatgaccaaatggccatgcaaataactagggtgtgttagacaactcttgcagtagtaatactgggaaaaaatcctcaatttcaatagcttacaataacaaactttatttttcttgcccacgggtttgtgggtagactgcatttcagctcatcttgactgggtttcgctgtgacaggttgggctccaggcttcacgttcacacgtgtaatgcataacttcaacattctgagatcagaagctacttgagcaacgttcttctcatagtggatggtagaattgcaaggaatgaagccaaagcatctgagcacatttaaacctgctgctcaaccgtaactaatattccattgtccaaagcaagacgcatggccaaaccttgtatcaatggagcagggaaataaaccctatctcctctagtgggacaaagcacacagtaagtgcatagatgtataattctattgcaaggagggagtgaagagttgaaaaaattaattctatctacaatatgggaaattttcttttttttaaagacaaaaggaacttcatatcatccctgcctccaagatatgacatacaatatatgtagcaatagcatgggaagttttcttacatcaaatttgcattagccaaagtcataaaataacttggtttccaactacccccaatatttaaatgattgttgttaaaatatttgtgtgctgtgtacgagaagtgcccagaaattatgttataagaaataggatcagactttgaaaggccttgagaaccatgccaagaagtttagccttgatccaagaataacaggaagctattgaggcccctgtaactttgtattcagagaccccaaaatgaccttcttcctatatctcactacagtgttagcccaggtgtacataccaacaaaattggttttatcctccttgcccatacctagtggggctttcagtacactaggcagatagttacacatcaaattttgctgatttattttaaaatgatggaaataaaaattatgtttctcatggtgtctgccctctttctactgaggctccacttaagagaagagtactatttctttgtttgtttataacttccttttttctgccccaactttgtcttcattgcctctattgtcctactattgtctgttatataagcaggcccatgtacgtgattcagaagaccttcagggcccaactacgaaaaattccactgttcctgtctccctggatgctatagtaacatgtacaaggatagaacaccaagtacatatggcactctctctatgcttattagcattgagtctcattagtcttactagacttcctctgtatcctcttttaatattctgactaatgtaacctctttgcttccccaaaactgtgataagggcatgtgtcttactctgtttgtgttgctataaaagaatacctgaggctgcgtaatttattacaaaaaagaggtttatttcacttagagttctgcaggctaaataagaagcatggcaccagagtctggttctgtggagggcttcaggctgcttccactcatagcagaaggtgaaggggagcccgtgtatgcaggaatcacatggcaagagaggaagcaagacaaaggggagggagctgccaaactgaattaaacaaccagctcttgtgggaactaatagataatgaactcattcattaccatgaggatggcgttaagccattcatgagggatccacacccatgactcaaacacctcccattaggccccacctccaacattagggaacaaatttcaacatgaggcttgtgggacaagtatatccaaactatagcagcatagatgggaaccagctaactgagatttcttcctgaggaaatggattttgatttgcagagtgaaactgggaaggatacaacaaatggaagtgcttactcattttatacctgaaaaaattaggaaagcttctaccctctaactacaaatagatttcttgagtacttattcattcattcattaatccattcaatatgttaattaaatgcctacaatattccaggtacagtgccaggacctgaaaatacgttatgagctgaaacggacacttttgtagccctgttaccagagtaattggtatagtggaaaaaataatggacttcaagccaaaaagagcggtggtctcccaaatactggccaaataattttttctagtctctgaaatgtagacaaagatatgtattctactttcctcccaggaaaaactatatcaattgctgccatttatatgcaaccacagtacaaatgccttacattagtattattttgagtttttaataacaacaatgctttagtgtaattactttactgtaagtacgcttgtatccctcattactgctgtgtaacaagaggccacaaaatctcagtagaacaaaacaataaccatttaacttcattcttgtgagcctacagatcagctagggttgttctgcttcatgttgcaggtctgtgggtcagctagggtgactctgatccacatacctcttattctgggatcagtgagctaccggggaggcacgttgttttcaagacagtggcaaaagcacaataaagagaagcagaaacgtgagagggttcttaaggcctacgttcagaattgcactgtcatttctatccatgttccattgctccaagaaaatcacgtgaccaagcccaacatcaatgaggtggagaaatacatgtcaacagtggcagagagaaggaagtgaagatttgctaaataatcatctatgtcatcccaactctccttttctctagttaagataaaaaataataatttggggtaggacatatgctttcaacatgccatattcctgctcaaaagccacactgcaatggctctgtagtacatgtttattaaacaagccaacagtgatcactaacccctttctcccttgacacctcaattagagaggctggaaagcccaatacttcctttcccatcctcctttgcctaaaaggataagcatatggcccagtcctgtccagtgaaacaaagtcagaagtctgacagaggcttttggaaaaacttttgttccctttagaaagggtcaggtatgagaacagagctggctggcaacaccacttccccttctttccaatatgaatgtagaagtgataccattttaagactaatatgacaagccaacatcctcaggactggttcactggtggcattaccagacatctcatgtgagtaaaataaagctttatttgttaaagtcacttttgggttacttgaagataaaatgcatcctatacagactctcaattgtctattagataaaaacgaaactcttctgcatggctttccatggccttattatcttggatcccatctgcctacccaccctttaaaaacatgcaccctcaactcaggccatactactctcttcatgtctttgctcttggaatgccctctctcttcccatttgctaatccaactacaatccattcttcaacaccaagctcataaccaactttcttcatgtaattcaactcaaagtgaactctttccttttctgaaacccagttgagagtcaatccaacaagaacctagcttagcttttgtgttctccacattgattgggtaactgtctcatagcccttaacaagaatgaacatttcttacggatggctccccatggctctgagtggtaccagtcttagaatatagcacaatacaataaaaatgtattgattattataaataggacatagtttctactttataaataggctggaatccaagtaattttcaagtagtcagttgtctggaagttagaatatattttctatagaaaatccaaccaatctacttccctagagatgtaaagagaaaagcatctcctcatctttcctttgccctagataagccctaatgcaatactcatccatttgttcattcatataacaaatatttatctggtacctataatattggtcatgtagcattactttgataagctatctttaacacgtctccatcttcctctctattactttctagaataccagcattttttttctatgctaagctccaactcagacttcctctctgccccaaatgctccatgttgccaaagttatctatactcctacccttatcacagggccttgttttttcaggcagtggtttaggagaaaacccatctgaccatgctaattcacacaagctatgaatcactaagagccatttacaagtcccgcattgctgctttttttgttcatataaactaatctttcgactctgtagaagttcattccaaatacaagttagaaaagctcacaatgttgaagaagtcatcaggtagtaggtaagctaactctcctctgaacccaggggcatgtcatgtcaagcatcttttcctccagttctgaacttaaggaatcagttttaaaacccaacttgattgaggtatgcttgatatacaatagcctgcacacatttaaagagtatgattttaaaatttggacatgtgtatacacttatgaaagcatcaacacaataaagggaaagaacatttccatcacctctaaaaattgcccccgtccctttgtaatccactgatctgctttccatcgttatagactagtttcctagtttttttatataaatggaatcatatggtagatagacgaagtatggatggaaagataaagtatttttggctcctttctggcagcttagtcgcgaacatatcaatagttcattcctttttattgctgaataatattccattgtatggatataccataatttttcttattcattcacctattgatggatgtgttggtaaaaacccacacatctttcaactattggggctattacaaataacgttgctatgtgatgaaaaaaactgaagatgacacaaataaatggaaagatgtctgttcatggattgaaagaactaatattgttaaaatgtctgtattatacaaagcactgtatagattcaatgcaattcctaccaaaatttcaatgtcattcttcacagaaatagaaaaaaattcaaaattcacatgaaaccacaaaagaccccaaatagccaaaccatcttgagcaaaaagaacaaagtttgaggcatcacactactggatggcaaaatatattacaaagacataataatcagaagagcataatactggcataaaaatagacatattgaccagtggaataagataaaaaagcccagacataaacctacgcatttatggtcaactgattttcaacaaagcttccaagaacacacaatggggaaaggagagtctcttcaataaatggtgttagggaaactacatatgaggaagaacgaaactggagttttatctcaccccttcaatgagaatcaactctaaatgaattaaagacttaaatataagacctgaaactataaaactactagaagaaaacatagaggaaaagctccataacaatagtctgggcaatgatttcctggatatgaccccaaaggcacaggcaactaaagcaaaaatagataaatgggattatatcaaactgaaaagcttctgcacataaatgaaacaattgaagcaaagggacaacgtacagattcggagaaaatatttgcaaatcatacctcaaataaaggggtttaatatccaaaatatacaagaaactcaaactactcaataacaagaaaacaaaatagctctattaaaaaaatgggcaaaggatctgaatagacatttctcaaaggaaggcatacaaacaaccaagagatatatgaaaaaatgctcaacatatttaatcatcagagaaatgtaaaataaaatcacaatgtgaaatcacctcacaattgttagatgtgctattattaaaaagatgaaagataacaagttttggcaagaatgtggagaaaagggaacccttggagaccgttggtaatattgtacattagtacattttgggaaacagtatggcaggtcctcaaaaaactaaaaataaaattatcatacaatccagcaatcccgcttctggatatatatccaaaggaattgaaattagtatgttaaagagttgtctgctctcttatattcattgcagtattattcacaatagtgaagatacagaaacagaagtgctcatcaatgaacaatggctttttaaaaggtagtatatatatatatatacacacacatatatatatacacacatatatatacacacacacacatacacacacacacacacacacacacacacacacacacatatatatatatacaatggaaaactaactttccagccttataaaagcaggaaattctgtcatttgcaacaacatgaatgaacctacaggacattacactaagtgaaataagacaggcacaaagagacaaataccatatgatcttacttatatgtggaatctaaaaaaatcaaacttcacagaagtaaagattagagggtaacagttaccagggactagaaatgagggggtacacagaaaaaggggagaccctggtcaaagggtacaaatttcagttagacggaggcacgattcacaatactcaatatatggaatcaacctaagtgtccatagttggataaatggattaaaaaagatgtatatacaaacaatggaatactattcagctataaaagaagaaggaaattctgccatttgtgacaaaatggatgaacttgaaggacattattataggtgaagtaagctaagcacagaaaaacaaacactacatgatctccctcatatatggaatctcagaaagttgatctcatagaagtagacagcagaatagtggctaccagaggctgagcaagggaggtggtagagagggaatggggaagagattgatcaatcggtacaaagttaaagttcaataagagatataagttctggagttctattgtaccgtagggttactatattcaacaatcatgtaccgtatacttcaaaatagctagaagagaggattttgaatgttctcaccacaaagaaatgacaaatgtttgaggtaatggaaatgctaattatagtgatttgatcattactcaatgtatatatttgtcaaaacatcacactgtaccccataaatatgtacagttattatgtgtcaattaaaaccaaaatatttaaaaaactaaaatgtcatgcacattcacatacatgtctttatagggacatatcctttcactaatcttggataaatatctaggagtgaaatggctgggtcatatggaaacctgaaatatatttggaaactctaaggattttctgtcattcccaaagtattagcatcagaggccttgttcataggtgcagaggtaagaggcatttaaacatcatgtgtttataaccagaggtttgccaatggttgggaaacaattcttcatgagtatttcattctgcgcaaaggcatcaacagctttagtactaaacttttttccaaggatgtctgtgtaatacagagccaggactagagtgaagcaagcgtggcacctaggattcaaagcttaaagagtcgtggtggcacagataatgaaaaaaagcaggtggggcgacagcccacccaggagtggcacagagaccaaggaacccccacccccagccaagggaagcagtgagtgattgtgcaatcccacccaggaaaccacacttctcccatggatctttgcaaccagcggatcagaagatcccctcatacgcccactccaccagggctttgggtccaatacaagagctgtgtggtatcctggcagagcagctgctcaggcacacacagaggcccaggagttttgcataatcctgccccaggattcctgacaaggcagaagattcatccctacatatcccttggagtgggggctgaatccagggagccaagaagtgtctgtgggccccatttccatggcacctcataacttaagacccactggcttcgaattccagccagccagcggtgacaggctggagccagcctagtaaaaggactgagttcccagggggaggagcggctgccaactctgcagtttggtcaactcaggtgttccagcctgctggctccagagagtccagatggtccagatgaggaaggtttccccacaacacagcacagctgtgctaccaaaaagcagccagactgcttctttaagcaggccctgatcttgttcctcctgactgggtgagacctcccaacaggggtctccaggcaccgcctacaggcacagttcaggctggcaacaggtcagtaccccgctgggacagagcttccagaggaagaagcaagctgccatctttgctatttcacagccttcactggtgatacctccaggtatgggaaaaacaaaggcaactagggtctggagcaaacctccagcaaactgcagcagtcctgtggaagagtggcctggctcttaaaagacaaacagaaaacaacaacatcaacaaaagagagcccacaaaaaccccattcaaaggtcagaaacctcaaaggtcaaaggtagataagcccacaaagatgagaaagaatcaatgcaaaaacgctgaaaactcaaaaagccagtgtgcctcatctccaaatgactgcaacacctctccagcaagggcacagaactgggctgaggctgagatgactgaattgacagaagtaggcttctgaaggtgagtaacaacaaacttcactgagctaacagagtatgttgtaacccaatgccaagaagctagcaatcaggataaaacaatagaggaactgatagccagtttagagaggaacataactgacccgatgagctgaaaaccatgagaacttcacaatgcaatcacaagtatcaatagcagaatataccaagtggaggaaaaatctcagcatttgaagactatctttatgaaataagacaagcagacaagaatagagaaaaaagaatgaaaataaacaaaacctctgagaaatatgggattatgcaaagagattgaaactacagctgattggggtacctgaaggagacggggagaatggaaccaggttgtaaaacatacctcaggatatcatcgaggagaactttcccaatctagcaagacaggccaacattcaaattcaggaactgcagagaaccccaataagatactccatgagacagtcaactccaagacactttatcatcagattttccaaggctgaaatgaatgaaaaaatattaagggcagccagagagaaagcccaggtcacctacaaaggaaacacattggactaacagtgggcctctcagcagaaaccctacaatccagaagagattgggggtcaatactcaatattcctaaggaaaataatttccaactcagaatttcatatctggccaaactaagcttcataagtgaaggagaaataagatccttttcagacaagcaaatggaaggaatttgtcactaccaggcctgctttgcaagagctcctgaaagaagcactaaatatggaaaggaaaaactgttacaagccactaaaaaagcacaccaaagtacacagaccagtgacactatgaagcaaccagagaaacaagtctgcaaaataactagctagcatcatgatgacaggatcaaattcacacataacaatacgaaccttaaatgtaaatgggctaaacaccccaattaaaggacacagaatggcaagctggataatgagccaagacccattgacatgctgtcttcaaaagacccatttcacgtgcaaagacacaaataggctcaaaataaagggatggatgaaaatttaccaagcaaatagaaaacagaaaaaagcaggagttgcaatcttagtttctgacaaaacagacttaaaaccaacaaggatcaaaaaagacaaagaagggcactacataatagtaaagggttcaattcaataagaagagctaactatcctaaatatatatacactcaatacaggagcagtcagattcataaagcaagttctttgaaacctacggagacaggccgggcatggtggctcatgcctgtaatcgcagcactttgggaggccgaggtgggcgaatcagaagttcaggagattgagaccatcccagccaacatggtgaaatcctgtctctactaaaaatacaaaaattagctgggcgtggtggcgggtgcctgtagtcccagctactcgggaggctgaggcagaagaatcacttgaacccaggaagcagtggttgtagtgagccaagatcatgccactgcactccagcctgggtgacaagagcaaaaactctgtatcaaaaaaaaaaaaaaaaaaagaaaaaagaaagaaaaaagaaaaaaaaagaaacctgcagagacttagactcctacatgataatagtgggacactttaacaccccactgacaatattagacagatcatcaagacagcaaattaacagacattcaggacctgaactcagctctggatcaagtggacctgatagatatctacagaattctccaccccaaaacaatagaatatgcattcttctcatcgccacatagcacttactctaaaattgatcacataattgaaagtaaaacactccttaacaaatacaaaagaactgaaatcataacaaacagtctctcagaccacagtgcaatcaaattagaattcaagattaagaaattcactcaaaaccacacaactacatggaaattgaacaagctgcttttgaatgactcttgggtaaataattaaattaaggtggacatcaagaagttctttgaaactaatgagaacaaagagacaatgtaccagaatctctgggatgcagctaaagcagtgttaagagagaaatttataacactaaatgcccacatcaaaaagctaaaaagatctcatattgacaccctagcatcacaactgaaagaactagagaactaagagcaaacaaacccccaaactagcagaagacaagaaataaccaagatcggagtggaactgaaggcaagagagacacgaaaaactcttaaaaaaaaaaataaacgaatccaggagctggttttttgaaaaatttaattaaaaagatagactgcaagctagagtaataaagaagaaaagagagaagaatcaaataaacacaatcagaaatgataagggggatatcaccactgaccccacaggaatacaaacaaccatcagacaataccacaaacacttatatacacataaactagaaaatctagaacaaatggataaattcctggacacatacaccctcccaagactgaaccaggaagaaattgaatccctgaacagaccaataatgagctctgaaattgaggcagtaataaatagcctataaccaagaaaagcccaggaccagacgaattcacaactgagttctaccagaggtacaaagaagagctggtaccatttctactgaaactattacaaaaaattgaaaagaagagactcctccctaactcattctatgaggtcagcatcatcctgataccaaaacctggcagagatacaacaaaaaaagaaagcttcaggacaatatccttgattaatattgatgcaaaaatcctcaaaaatactggcagaccaaatccagcagcacatcaaaaagcttacccacaatgaccaaattggcttcatctctgggatgcaaggttggttcaacatatactaaccaataaacgtaattcatcacataaacagaaccaaagacaaaaatcacatgattatctcaatagatgcagaaaaggccatcaataaaattcagtatcccttcaagttaaaaaccctcaataaactaggtattgaaggagcacacatcaaaataataagagccatatatgacaaactcacagccaatatcataccgaatgggcaaaagctggaagcatttcccttgaaaagcagcacaagacaaggataccctctctcacaactcctattcaacatagtattggaagttctggccagggcaatcaggcaagataaagaaataaaggtattcaaataggaagagaggaagtcaaattatctttgtttgcagaagacatgatactatatctagaaaaccccatcatctcagcgcaaaagcttcttaagctgataagtaactttagcaaagtctcagagtacaaaatcaatgtgcaaaaatcactagcattcctatatatcaacaccagacaagcagggagccaaatcatgaatgaactgccattcacaattgctacaaagagaataaagtacctagcaatacagctaacaagggaagtgaaggacttcatgtagaactacaaaccactgctcaaagaaatcagagaggacataaacaaatggagaaccattccatgctcatggagaggaagaatcaatatcatgaaaattgccatactgcccaaagtaatttatagattcaatactattcccgttaaactaccattaacattcttcacataattagaaaaaagaattcaaaattcatatggagccaaaaagagcctgaatagccaagacaatcctaagcaaaaagaacaaagctgcaggcaccatgctacccaacttcaaactatattacaaggctacagtaaccaaaacagcatggtactggtatgagaacagacacatagaccaatggtacagaatagaaaactcggaaataagaccgcacacctacaaccatctgatctttgacaaaccggacgaaaacaagcagtgaggaaaggactccctatttaataaatggtgctgtgagaactggctagccatatgcagaaaattgaaactggaccccttccttacacaatatagaaaaaataactcaagatgaattaaagactgaaatgtaaaacccaaaactgtaaaaaccctagaagaaaatctagacactatcattccggacacagacacgggcaaagatttcatgatgaaaacaccaaaagcaactgcaacaaaagcaaaagttgacagataggatctaattaaactaaacagcttctgcacagcatcagagtgaagagacaacctacagaatcagagaaaatctttgcaatctatccatctgacaaaggtctaatatccagagtctacaagaaacttaaatttacaaggaaaaaacaaacaaccccattaaaaagtgggcaaaggacaggaacagacacttctcaaaagaaaacatacatgcagccaacaaacatgaaaaaaaagctcaacatcactaatcattagagaaatgcacatctaaaccacattgagctaccatctcatgccagtcagaatggctattattaaaagttaagaaataacagacgctggcaaggttgcagagaaaaaggaaagcttttacactcttggtgggagtgtagagtagttcaatcattgtggaagacagtgtggcaattcctcaaagacccagaggcagaaataccatctgacccagcgattccattactgcgtatatacccaaagtaatataaatcattctattgtaaagatacatgcacgcatatgttcattgcagcactattcacaatagcaaagacatggaatcaacctaaatgcccatcaatgatagactggataaataaaatgtggtacatataaaccatttaatactatgcagccgtaaaaaggaaccaaatcatgtcctttgcaaggacatggatggagttggaagccattatcctcagcaaactaacgcaggaacagaaaaccaaacaccatatgttctcacttataagtgggagctgaatgatgaaaacacatggacccatggtggggaacaacacacactgtggcctgtcagaagggagtgtgggaggagggagagcatcaggaataatagttaatggacactgggcttaatacctaggtgatgggatgatctgtgcaacaaaccaccatggcacacacttacctgtgtaacaaacctgcaaatcctgtacatgcacccctgaacttaaaataaaagttgaaaaaaatgtaaaaaacaaaaaagagtcacggtggtgcacacctatagtcctagccacttgggagtctaaggcagtaagatcgcttgagcccaggaattcgaggctgcagtgagctatgatcacaccattgaactccagtctaggggacagagtgagaccctgtctccaaaaaaataaataaataaaagaggcacatgcttccaggttgtgctagttcaactggcccagaatcgtcagcacctcagagcaaacacttttaaaatggtgagtcttgggcacttcacttgcctcatcctagtcctggagctatacagcaaatagccttggcagatacagtgtttccctccagagcaaagggaggagccatgggagagagggtggggtgttggagaagaacctcagaagagagagatttatgagaagggtctggaaagccaatctaaggaaagtaggactttttaagtacaatggatgcttcaaagttgacttttgcttattttgcttttaaatggggaagccataggatatgtatttatcacaatgaattatgatcgcttgtatctataaaaaattttccctgctaggttttcagctcctcacgggactctatcttgttcacttatgccctccagcttcaccccaggaacagaattgctactcaaaacaaaagttaattgaattaattaatgtatcttaacaaatgagttagcaaaaactaacttcccctctcagatacttcacatgcattatgtacttcaatatcccttgtttgtgaataattttaaacaactaaatgaaaaatttgaatgttcttgaggttgttgaacaaattattataccaggttatgtcttacaatttttctctcacttttcattactgtattcatgagatggcatatttttaatcactttgtgtgggatactaatacagtagttatctgcactgtaaaataaatttttatattctttttattaaatataactttttaaattcataaggtgccatgtattattcattgacaagtcttggctcatgatacagattatatatcattttttccatgtgtcataagtggtcacttagattgaaataaaattatatttaataaaactcagagctggcaaatttttctttcatttcaaagtgaatttctggccacttccccttgccaaacgttacggatgaaaaatctttcattaagacacttataagaagctcatataccaatatttattttttctctaaaatgctttcttgggtctaataatttttataggttaatagtgcaaaccccttgagagaaaatatatgccttattcacaaagaagggagaatataacatatgtatatatatatgtagagagagagagagagagtccattgaaattttaccagactctaaatccactagattctgccctttttctttcaattcaaaaaagttcaaagttcttctttaaaacaatgtataattatagaaaacgtattagtcaaaattatttttattttaaatgcactataaaatttcttaaaattctttcatagctataattttgcctacaatactatacactttgataagtgcagaatctttccagaactatttcctttattgatagaaacttacacttcctactgaggaaaatcaggctcaaaggtgagaaatgtataacttaaagagttgctcatggtaaccagaaactctagcttctcttttcctaagcttcttttaccatctacaaatataagcttcagcttctctcctttccctgctctttcctctaagcacttgcacttgcttcttaaaaataatactaccagtatgctctgccagctctcaccaatgttagttattattaccacatttatactgaaatttgtgaagtctgacaaaataaggtgtaaagggaaaccaggcatgtttcttttatcaaccactgtttgtcaccaattgttctgtaaccgggtggatgagaaaggggtgttggaagtctggtccttacatgggcctctcaacttgattcccatctgtaagcacagccctacccacatacccaatggtcaccatggaaaacagctgagagtacaaaggaaacccaactccactaccggcaacaattgactcaacttcaggaaaataagcactagagggaaaaaagagaaagcctggaatcttctcttaacgacaaacccctagccatgtcatgtgcaccctgagcttccatgttatcatttggaacagaaaaacaactagtgcctatttctcaaggcagtgtagagctcaaatgacacaaagcaagtaaaagcagtttctaaattcaatctagttttcaatttgcattctcttttttcctaagcatatgtattttcactgcgccaaaattatatgcattatatcctctttaaaaaaaaaaaacacacatttagattaaaaaacaatccccttgggtctccaaccccagttatatccatcatcttcccttccacagagcaagcattaccaggagctagtatgcatctgtccacattgattgcacaaagatatctacttcttttccctttaactgcagtttgttatgccattttgtaaacagaccacattttatttatttattcttcttttttttttttttttttttttttttttgagacggagtctctctctgtcacccaggctggaatgcagtggcgtgatctcggctcactgcaacctccgcctcccagattcaagcgatgttcctgcctcagcctcccgagtagctgggattacctggctaatttttatatttttagtaggggggtgggtttcaccatgttggccaggctggtctcgaactcctggcctcaagtgagccgcctgcctcggcctcccaaagtgctgggattacaggcaggagccaccatgcccggcctgttcttctttaaacagacatttgtttccaatattttattagcacaaataggcctgaaaggagcatctttattccatccttgtacaccagtgtgagcatataaggcatgtagctcaaggtggaatttctaggtcattaaggttcacgtattccacttgtaacttttgccacccaaagccttttcaattcttttacatgctcaccagcagtgtacatcagaggacctgtttcctcatattctgagtattttcagactttaaaagtttggtcattccaatgaatgaagaaatgacattttgctggttaatagtcaggatgaacttcttttcacagaatgtattaaatatttggatttcttttctgaattgcctgggcaacctttgcccatttttctgttccatattttttctcttcttattgaggtataggggttctttatgcatttttggatactaattatttgtcacatatggtaaaagtgtttctccccatctgttgtttttccttaaattttgtatacagtagtgtcctttgacttgcaaaagtctctacattgacgtagtcaaatatattgttttctttttacatattgtgctttttgtgatttgtatttttaaagtctcccattcatcatggtcataaagatactatactacagccaggtgtggtggctcacgcctgtaattccagcactttgggaggctgaggcaggcggatcacttgaggccaggagttcgagaccagcctgggcaacatggtgaaacctcatctctactaaaaatacaattagccaggcgtggtggtgcacaactgccattccagctacttgggaggctgaggcacaagaatcacttgaacccaggaggtggaggctgcagtaagccgagatcgcaccactgcactgcagcctggacaacacagtgaggctctacctcaatttaaaaaaaaaagatatactacaatttcttatattttaaaggttctttaaaaaaaaaaaactaaacatgtaatttatctggaaatttttgtgaacggtgtgagaaagcagtctatttttaatgtcaaagtcattttcctaacatgatttattgaatggctcatcatttcttcattgatttttaatgtcattttcttcctggaacaattttccatttgtttccatgttctccattctgattctgatctacctgtctcttcctgcaccaacagcatgctatgctcattactatagccacttaacaatgtgtcttaacgtttggtaagttccttttacaaacacgtcttttctgcccatttactattctataaggattgtagaatctggccagttccattaaaaatctcagtgggagttttggtattacaataaattcatagattcatttggaaaaagtgttccagctgaataatgtagcttgtatctgcatttacttagatatttcttgtcttttaacaaagttttatattttttccttaaagatattatatatatttgattggctgtgtagttttactaggtttgtattgttgttgctatactgaataggatcttacttcttacctatttaattggttgctactggtgtatgggcacaatagtaattttttatgctaatcctatctcaagaaatctgactgaactctcttactagttttacagcataggtttatcctcttgaattttctgtaaatggtttgaaaataatgaaattgtgccttctttcctgttacagtctttatacttcttatttcttttccctgttgtatcatattatgaggacctcccgtacaatattaaatagtaggagaagcagagacatcttcatcatgtctcagatccagcctcaatggcaatacttcttgtcagcatgaattaccatctttgctgaatctttatttctgttcactatgagattgtatcactaatgggttttgaaattgtatctctccttttgccattgattagagtaaatgtatatatctgttttcttttcatttgctaacatagtgaattccactgatagccttaatagtatttaaacatcttgtattgctggtataagctgtcacttatttttacagctttgctatttttccaattttttatttgagttttcttatcgatgtccttaagtgagactgacctctaattttcaattgaccttactggcattagttatacccatataaaataagttttataaattctactctagatgtattctatggcaaattttgtagaagggtatgtctgttcctttacattttggtaaaatttagacataaaattctttggtgttcaagttattttgaggagagagggttgtattttaaatcagtgttttgatgttttattgactttttaactcaagcttcctacttttgggctaagattagttattatatatttgttacattgtagatgttctcttgtaaactgtctatatggtcatgcgtcatttatcaatgagatatgttctgagacatgagtggttaggcaattttgttcttgtacaaacatcataaatgtagatatatttacacacacctaggctatatggtagagcctatttctcctaggctacaaacccgtacagcatgttactgtactaaatactataggcaattggaatacaatggtatttgtgtatctaaacatagaaaagtaaagtaaaaaatggtattataatctcatttgtccaacaatgtatatttggtcggtcattaactgaaatgtcattatgcagtgcctaactgtaattggattttatattccagtctgagactcttaactgaagatcgtagtccacttgcatgtttgtaattactacatttgaacttaattctgccacttcatttcttttctgtttaacaggtttgccttttatttccattttcctgcctccagttggattgatagtatttttttcttcatgtttttctccccattaccaattaaaagccatagtctatttctttacttttagggattacctttaaattgttaacatacatacttaaatttatgttttgttaccaaagattaagttaaccattacctattccttcctccaccacaaacaagaaactttaaccatccttgatttttatataattccactgggattcaaagatttgttgttatttattgtcaattgcttcttcctttgtagataatatctccccctccactcccacccctgtagcttctatgcttctcttttcacctatgatgtcctaaaacgttattcaaataagtctagatatattttttggatcctgctcaaatttggacgtcttctatctgagaatgtccttcagtctcatcttcaactattgctccctctatgtacctctttctggttttgaaaaatctattagataaaggttggaatttcttctagaacatatctactttgttttccatcttttaatatctatgctacattttgtccatggttatctccaaccagttatgcaagttatacaagatgcatacttcccaaaatgacctcctctgagtggatgagtttggggcttacatttggcacaactccaggttttgtggcccatatgtaaaattagttcccgaatttttaaaactcatgttttaaaaagcacttgggatactctcatggtaagagaaggcacgattcaatcaactagaaaatagtcttaagtgtgggagtctaaaaggttctctggaagtgcccaactggttgttgagtaaaatgctaaattttactacgcttcatctttttaatcaaaaagtaaattatataatctctccacctctgtctgtcaatcaaagaaaattaatctataaatgcctcaaaatataaaagtcagtcattatatgaatacaaattatttctatgaatgccatattgcgcaaatcctcatcccttgctttgcaccgaatgtccttcaaatttgtcatcatttatagccttgtctttaaggcaatttccttcaacatggaaattaagatttgccagacgtcagtgtagtcatgttctgaaaacgtccatctcagaaaacaaatagttttaagtgctttattgtgcgcacatgtttgattttctttggcttacatttcctttaagaaagcagcaagacttaacacaaccaacaggcatttgaatatggccaaacctttaaagcaagtcactaaactttcctgagcaaaacaaaaaggaatcttaggaatcttagagggatgttttaaaacacaacagtttatctttaaaacagctcatatttttattcattttagttcttttaagaaatcaggaggttctaattacagaatttatgccatattaagatcattcactcttgaataagttttacagttcgtagtgtgctttcatatacatcaattatttattcttcacaaaaagcctacaagtattgctttactaaggagaaaactgagcttaagtgcagttaaatgacctatgtagcaacaaacccagtcagtggctgaacccagactcacagttacgctgcccacgccaaggtgtttactgccttctccaagtccagctctctttgaaatcactttaatgaaaatcaccgtaacaaacaagacttacaacagtcacttaatgactccacagtttaaaggttgctatcagattttgctgccacaaaacaattagacgcattttattgtaatcagatgcaatctgtatttaaacagccaagcttttggtctatgattttcttaggagattctgccccaatgggttaacagagatatcaacaaccatcactacaatccggttttggaacacttccatgcccttagtaagatccttcacacccatttacatttattcacccctcccaccccccagccctaagcaactacgaatctactttctgtctctacagttaccttttttggacattttaaataaacaaaatcatgcactatgtagcctcttgcgcctggctttttcacttcaaataatgcttctgaggtttttccatgaacagcatatgtcagtagtttgctccctttcactgctgaataatataccattgtgtgaacataccacgtttgtttatgcactcaccaattggtagacatctgggtagcttccacttttcctgaaccaacttttactgcaatttgacagctagttgtccacgttctgtgttctcctctccaggactccaacttcctaagtggctgtgggtgcctgtagaagatcagatctgatgtctcagttccctctgcgaactatgatccttctcagtccctagtccaatggattacaacaaaattagcttttaaggactagtaaggccattatgtgactttttccatcttccttttttattactacactatgagcagggtcatttaaggtatttttttccagcctctgaggctgtggttacggttgcacaactccaattttcctaaaagtaattgaattgtacacttaaagtaggtgaattttatggtatatgaattatatctgcataaagttgttaaaaggagaaggttagggaggacagatgacaaaacaagggtatagaaacctaaatgataaggttcaacttgtcaacctgagcaacagatacaaccatgaaaagacccacagacaatcctgaatgagtcagtcagcacttcattagattcagcgtaattctcgcacgcaactgggaaaaatgggcagcagggcacatggttaacagaacacactttttacgccatcaaaactaccttcaagccctgtatcagccacttcttagcaaaataagtcacccaaagtttagagtagatttaacaaataacgataaaagaaactcagttgaatctgaatttcagataaacaatgaataatttgccagtatatgtatgcctcatgcaatatttggagcatacttatatttaaaaattatttgttgtgtatctgaaatgcacaaataactaggggtcctatattttatctagcaaccctaccaaatttacatatccccttggtaatagggggcatgttagtaaaaccagaatatagaattgtaagattgaataggccatttaaatacattagcaaccgatccctaaaaattagcttgttatataattgttcttctgccttaaccacctctttaggtgttcaatcatcccctgcaatgtggagccccatcctgagccacagctggctttgatgggatgtcaacaaatcactcaggtcttgctaataaccctaccatgaacaactgacatacaacagctaatcattcaccacagactaagtcctgggcatttcgcaagaggtagttcctatgtagggacttaggaaggaagactagggaagggaaagaagaaactatgcttagataacgagcacagttccggaactaaaaccttccccctggactcttttttatgccatctaccatcactactcccactgttccatgctgaggacaattcatgatgacgacaggttaaatcaaacccatgtacacgaggttttagccaccgtaacagccagctctcccacactctggcgtatcaacaatgccaggctatgttcacgtgacctgaagataagggagcagatcattcaaataactttttcatattactttctgattctgaaagcaattcaaaaagaacagtagaaaagaaagaaaacagtgacaacttatcacctaatgacaacctgtgaggaaaaaagttaaataaatgctatgtgtaattttacacagatagcatcatactttacttttatatcttccttatttacaataacatgattatttttcccaaatattttccaaatacatgattcttaatgagtacctaatactccacagaataattctataaggtaaccattctatttggttggtgtctatttcttatgattttcagtaccaataaaatcaacagtcttgtacagatacctttatttacattaacataatttccctatgacacattcctagaaagggaattactacatggacaactgccaaatttctttgcatatatagtacactaattcgtactgccactagtactgagaatatatagatctacttttataagccccacatctgcaacccaaagacctgttccagttctaaggacaaaaataacatggttatttttgagagaataatacaactctgacttctctttattcctgtcctcaggataatcttggtattcacagaatagccgagagaagagaccaccaggagttcacacgtgtgaggcaaatgtccactcaccatgctctaatggcctacagagttctgtagatgtcaaatatggcttttatgtaatgcttcttattggactcactctctggggttggaagtagttactaatagagtgtgagagcaagatatcaggaggcagaattgaggagagtgctgggtggccgtgctaagtgctcacatactggagttccaagaataaatcactaggtggctcatttatattgggctctgtccagtggaggatgagctacaggtaaacatgagcatcatggatctcagacaggtaaaagcataagggcattgattaagactggcatcagtgaatgacagtagtcaaaactcatagtttggtcatagaagaaactccagttattattttttttttgagcagcaaagtagtaggcatattttcgtctctataactgatccattctatctgaccagctagctacaaggagacagatgtcgacttgtttgaaggacaagatgtgaaactttctagaatgagaaaggacagatgattttagtgaaaacagacttgtttaaaagtccttggaaccaaaataatttgaaggcaaaaatcatgggtcctgacaattatagagagtcttggcataggttaaaagtatatcattttggagaaagtattaccagctacttagataatgtctgagctttagaataaggggaatctaatactgaaatgcagagatacagtagctcagaagtctaaggaagatggtaaatgttgcaaaaagccttctggttgtttcaggatgcctatgggaggggtgtagctgtcacatgtagttacatagtattctagaacaaggcaggctcaaggtgaccaaaagtctttcaatataagataggcagtacaatagatcccctaagagccagttacatggcataaagacagagcaagaatacacagatctaggttgctttagccgggtggtggttctgcctggctgagaagaatttaaagagcttctaaacttaaaggttcctagcctctcccagtatgaagtattcagttccattttttagtggagactttatttcttagaaacttttttaaactttttggaaattaaacgtaccaaaccctcagaaaagatgacacaatccagaccataagaatggattttgattaaaaactttagacatttaaagttgtcgaaatagatattagttggcccttgatttaagaaaaaataatatggtctgcttatgctgacatttgttgattttagtgttagaatccttaaagctaataagcaaggaagtcttcaaaccttgagctaataattatgaagaattttcttaagcttttacaagatttcactgactaacttggagttttccatattatttaagtattttcacatttatatgtatcttcttgtttatcttcttccctcttcaggctataggaccccagagcagcacgggccacagaacgggggtagagaaggcattgttcactttttaatatttctttcgctcagttgaagtttgtcttctgcttcattcttacacttttcttttgttgagttttggaagaatgagtcaacattatcactggagaaaaatagcagtgtctaaaatttagaatcacagtagttcactagatttactcattattgttcaactggtggtgtttactctgttttcctatgctcaaattagaaataccacaaatctgtatgaatactatgtgtcattaatatcgtcgggttaaattctttaattttaaagtaattgttgcaggaaaaaacataagagcgaaggacagaatccaatatagtatatacacatctagatccatttctgcaccattcttggaacaaaaccctgagttctattttagggaacattaaaatatctgttgttgaatcgttatgtgctacttaagacataagtaaacccaagttagagagttggatcaaaagcctctgaacaagacaaatccctatcaataaatggttatcaacagccaataagctcaatgtttagttccttactcaatttgctatagtcgaggagtcaaaattgggactttcaggccaaattcaacctaaagaaaaattcaaaacatttcacaacttttcaaataatttgttatctcacatgggttgagggagggagagaaattccctagaactctggcttctcttgaactcagaagttcagatcgtgcagctatatgttaccttcttacatggcaccaatctgctggttctccttagctgctgtcttctttagacaaggcatatgctgtcccattcaccacagtcctcactcttctctatcaccactcctgggccacttcctttatttatataacttgcttggccactgtaggtattttaattagccagcaaatatggcaggcagacagggcttcagcttttctgcttctcccacacaagtaggcctttagcctctgctttatttctgaccatgacaatgaggctatagatttacaatacagacaggaagcagatcaccctgaacttcacctgttacctatctcgttgggacaagaagtctaattcctaggcttaggattcaactccaaatgtgcagagaaaaggaaaaaaaaaaaccacacacacacacacacacacacacacacacacacacacacacacaagtgaagaaatcaatcaaggtcacaaagccattccaagctgttctgtgtctacgacccatattttttgattttccactcctcagaagatcaagaggtaatgaggaatttctcataataaattattacgagtctctagggtgggtgctctgagggctcatggcttagacttatagacagcatctgcctcaccatggagtattcagtagccttcagtcttaccctgccagtgagctctcactggggtggaacaggctgtccagcatggtaaagaagcaagctgaaacaaagagtttgtcactttgtttttattttctactttgggttctaacaaaaggattcaagaagagagcagtaaatcaagcaagcacctgctcatcgggttgtctattgatgttttcacttaccgtccaggatattcaaagagaggctcagaagttttggcataaagaaatctttttattttccatgatcaaaattgcctagccagaaagggcatcaaagccacggtatcttcagaggaagagataaattcactccaggttgacaggagggtcaccttggccatttcttcccttgccttagaaggagggcaggaaagggaagaccaattttgactggcaaatagagaatgcctcaagaaggtgaagatatgccatggatcacttctttccaatgtgcatataagtcacttggaaatcttgtgaaaatgaatgtgggttctaattcagcaagtccagggtggagcctgaggttcttcataaagctctcccaacatgctgatgctgctgaacctctgactacattttgagtagcaaacccatagacatcattgacagaggttttaaaaaagacagaatataatttgtgatttactttgatacaagatatgcatgtagatggcaactagaaccttatagtcgacttgcgtgatcttgccaggaaagtcatcattcacataagaaggaacaagccaacattgagtctcacggtgtgagggtaatggaggctgggttcaatgggcccagaaacatatatagaaatcaagaagggaaaagagccagcagcagtcatagaaacagcaacgaagctgatcaactgaataaagaagtcaatgtttgaatagaatagcagagaacaaggtagcctgaggtacttgctaaagtcaagctcagctagcattgaagaatgcgagataagaattaatgaggtcttggagaccagacagactcactggcacagagcaggcaaacctcaaagtcttaacaacgggcaaccggaagaaatcagcacaggcaaacaaagaatgccagtgtgagcgttgggccacagatggagaactaggcaagcagggagatgcctaggtgtgagatgtgaacatacctgctgatcttcagcttccagaaagaactgggcaagggaaataaaagcatcctactcccagaggaaatcgtatgtgcggcaagaaatccaagaaggtctaaaatgtgaggactggaactctgagcaaaggcccaggtctgtgacccatatggaatcagtagcaaagttatatgttactgagccaactaaaggccttatattccttcccagcacagactggtcccagagcccgtgtgcggcggaatcaacaggtgttcagttaagaggctacagctgtgaaaattagcaaacggcgctaggcaggttagtagagcagtgagtctcaaagtacgctctcaaatcagcagtatcaacatcacctgggtacctgctcggacatgtgaattctcaaccccaccccaaacttaatgaatcagaaattctggggctggagcccagccaggcatgttttcacaagccctccagagaattctgacgcaccatgctcaagtttgggaagtaatgccgtagtttattcaaagtataaatggagacaaggccagatgtggcaaaggcgtggccttaatcatgatgctttcaaagagctggtgaagactgaaatcagttacaggggaagaaaatccagtagagagaatgtgaaagaatgattaataaaacgttcaggggttaactgagtcaggcaatgatattaaaaggcagagttatatcaatgtcgaaggatcatccaaccatgtgtattcatattttgattctgataacgagagaaatcatgagtgtcaaaaggggtcaactcctgtgttcgaaaatgttctcatgctgtatttttaagacagtcacctcaaagaaatgttatttggagctcatgcttatgaagatttcctctcagtgggggaaaaacaaatatggtagtataatgtgatccattcgacagaaatattgagaagaaatttgttttaaatatgtgtttgtttaaacacaggtgaaggatgaaaacatatgtgtaggtttttaattatacttattgattcagcaaatatctctattcagacactaaggatgcaaaaccacataaaccacaatctctttcaaaatatttgcagtgtagtcctaggagaggacaataaattcgcagttggcacagctatactagaggtttgccctccataaggcagagaacttttctcaaaagagagaaatgctcagtttgactctgaagaacaattgaaagaacactgtagtagaaggaatgatatgtagggaaggcatggaggcaggaaaggccttttgggaagtgctagaggcttagaatggctggggggagaggacatgaggctagagaactagtaagcagagaccagcccatcatggccctagctgccatcctggtaacactggtgagccagggaggaccaggaacagatgtacccttcagaaagaccactctgtctcagtcatagggtaaatgaattgacaagagggccaggaaggaggtgcgcaagatcagtaagaaaaagatgatcgtaactaagttgatggactagggcatcagagctcaggaatgcagaaattatgcagttctaagagatggcaaggcttatgatgtgacaaaactgagatatactgatacacctgaatcaatcgtagaatgagccctatgttttttttttcttaccaatactagcaacaagttggagatcaatttggttatttttatgaactagaggcaatttaaggccatccctgtaatgatgtcagttttatatttcaatctgctttttggagtgggagaagaagggcttgctgaggccacagtcattgctgcacatctctgagaatacagcagtgacaagatgggaatgcaccccctctctcctggacctttccagaggctggcaaggggggtaggttatatacctcacaggccaggaatggagttcacatcacctgcaggtcatcctacccgtcttcaggaaaggtggctacaaccctcttctcctccctctaacctcaagtgggagagctctggcaggcattgagggaagtcatcttgaggccccaataggccagagctctggtgatagcggcttccaagaatggaaccacaagaggtacctttctctctctctcctgctgctgctgcagctgctagatcccttccctttggtgggattagtgtggagagacaaaaactatgggtgccttctgtttgtaagggggatatccagcctgaccttggcaggccaagcaagaccaggaggcagttctcaggaaaagatgttggctcaggtctggccctgcccagagtctcagagaggagtaggggtaggaggaggatataaaatgagttatagaggtttctgcaaagtctagaccaattcactggttaggtcataagttgggcatttgctggacacagacgcctaagccataaaagcaaagcgggcatatgcctcaggttcccttggtcatacctcagtccctcaagcacagggtgcagacactccgattctgctcccagagatatgactaacaccaagtaagatctacaggatagtttaatattgaggaatagagattttaaatgttctaaaggtcctgaaggatttacaataaaataataaatagcagtctttcctgagtggtaggatttcaggtaatttaaaaatttttcttctctttaatcaccggaaacttctataataaatatggtttccactggtgataatagaaattaaaattatttaaaacatcattaccatgttgaaaaaagaatccaatgttaaaaagtttgatattttcccacacatctaggagatataaatatgtatacatatataagagtacctaaagaaaaaaagaaaattaaagtgatgaagctatgatagaaggtaaatatgttagaataactgatgaaaatactgtccattgtatgattcaaagatgtacaaaacctacccaagtgctactaaaatattactattcacagacgagaaaatatacaagactgtaaattcccttatgtaagcctagtatactagagtcccatttcaacgcactgaattataattagcttccttaggcgtaggagctataatagacagtaggcacctcaaagattaacaaagatatattcaaaattgggagactaaaataattcataatgatgagaaagaaaaggaagtaagccaaaagaaaagattgcagtatcaacaagccaatgttgtcaatttaaaaatcagtgtgcatggattttaggtgacttaagagttttcagcattttctgattttttccataattaaccccattaaaaagggggcaaaggacatgaacagactcttttaaaaagaagacatacatgctgccaacaagcatatgaaaaaggctcaatatcactgatcattagagaaatgcaaattgaaaccacagtgagataccacctcataccagtcagaatggctattactaaaaagtcaaaaaataatagaagctggcgaggttgtggagaaaagggaacacttatacactgttggtgagagtgtaaattagttcaaccactgtggaaagcagtatgatgattcctaaaagagctaaaagcagaactaccatttgacccagcaatcccattactgagtatatacccagagaaatataaatcattctaccgtaaaaacacacgtgtgccaatgttcattgcagcaccattcacaatagcaaagaaatagaatcaaactaaatgctcatcagtgacagactggataaagaaaaggtggtattaaatatgcatacaccatggaatactatgtggccatagaaaagagggagattatatcttttgcaggaacatggatggagctggaagctattatcctcagcaaactaatgcaggaacagaaaacgaaaataccacgttctcacttgtaagtgggagctaaatgatgagaactcatgaacacagagaaggcaacaacagacactgaggcctacttgagggtggagggcgggaggagggagaggagcaggaaaaataactattgggtactaggcttagtacctgagtgatgaaataatctctacaacaaacccccgtgatacaaatttagcaataaaacaaatcctcacatatacccccaaaccgaaaagaaaagttaattttttttaatttaaaatctatatattggggagaaaatactcgtaaaacataaatccaacaaaggccttgtatctcgaatatattaagaactctcaaaactcaacaatacaaggtacatacaggattctgatttctctccatccttgtcaactcttattttcctttttatataaaaattatagcaatcccagtaggtgtaaagtggcacctcactgtggttttgatttgcatttcagtaatgactaatgctgttgagcagcttttcattgcttactggccatttgtatgtctttggagaagcatctattcaaatccttagcccatttctaagttgggttgttttttcttgttattgttgagatataggaactctttatgtattctggatattaaactcatcaaatatatgacttgcaaatattttctctcattctgtgagttgtcttttcactctcttaatagtgtctttggatgcacaaactttctaattttaatcatccaatttatctattttttctttggtttcctatgtttttagtgtcatacttaagaaatcattgcctcaaaacgataaatatagaatatgacccagcaattccattcctaggtgtatacccccaaagaattgaaaacagggactgaaacaggtacttgtacacaaatatgcacagcagcgttatttaagataaccaaaaggagaaaacacccacaagtctatgaacagatgaatggataaacaaaatgtgttatatccatataatagaatattattcagccacaaaaaggaatcaagttgtgataaatgctacaatataaatggaccctgaaaagattatgctaaatgaaataagccagacacaaaagaacaaacgttgtatgactctacttgtatgaaatatctagaagaggcaaatttatagagccagaaagtagattaaagtttaacaagaggtagggggaatgaggaatggggacttaatgcttatggacacaaagtttctgtttggggtaatgaaaatattttggaaataatgatgatggtcgcacaacactgtgaatgttataaatgtcacagaattatacgcttaaaagtggttaaaatgataaatgtatattgtatgtatattttatcacaataaaaaactcaacggttaaataatgcaattatgaaaaggacaaaggacacagacatttcactcacaaggatggcaaataagcacacatgctctacttcgtcagccattagaaaaatgtaaattttaaccacaacgagatatcactacatctatatcagaatgattaaaataaaaaatagtggaagaccaaattctggcagggagggggaaagggggaacaactagatctctagtatattatgggtagtcatataaaatggtatggtcactctggaaaacagtttgacagcttctcataaaattaaacatgcgattaacatgaccacacaatcatacttttgggcctttatcccagggaaatgaaaacttatgcttacataaaatcctacacatgaattttcacagccgctgtgttcatagtagcaaaaactggcaacaatccaaaagtccttcatcgggttaatggttaaataaactctggtccatccatacaatggaatattactcaacagcaaaaagatataaactatcaacgcaggcaataccatagatgaatctaaagagcattatgcttaacaaaaagtcactctcaaaaggctacatatcatatgattttatttacataatattcttttttcagagggggcatgaggtcttgccatgttgcccaggctcgtcttgaattcctaggttcaactgatcctcccacctcgacctcccaagagagatgcaaagcacatttgtagttgccatggtatgcaaatataaagtggtagcaggaggtagttactttgtggtgatggaactatcctatatcttgattgtcatggtggttacacgaatctacacgtggaataaaattgcataaaaatacaaatacacacacaaattaatacaagtcaaaatgtcgaaaaccaaacaagatctacaatctagataacggtgttgtgccaatgtcaatttcttagtttgatattagactacagctgtataaaatatcaccattgggagaaaccggaggaagaatacacaagactctatgtactatttttgtaactttctgtgagtctataattatttcaagataaaaacttttttaaaaacacatctaaattggtacatgaataccatggacacattttattttgcttctttagcaaatgggaaatttctcataaaaaaaaaatgtaatgttaaactaacacagtataagggtgaccacactactaaatttggtattgtagcataagaaaggcccctttaaaaattggtacatgagaatgaaaatgaaaatacggaaacctgaaacaaaatgcatccactgtagaaatggccaaacacaaatgacactaaataaaccatattttttaaatgtatctagtgcaccaattcttcccatttcccaaattgtccatgcacaaaatccttatttatacttgtggttttatttctgtgtacaaaagcaaagtatatatgtcactcttcctagaagagggtgggtagtgatgaatatacattttttaaagaagaggaaacttgaagttgtaaagcaaacaaggaattaacgtgggtggcagagcaagagtggagggctttgcagtgaagctggggagagataaggaaagctgagggaagagagacctgcggttcaaatcaacttttgtgatgggaaaaataaaataatgaagagtactctgacaggaaaaggaaaagctcatcaccttctaaggtctgaccacaacctccctatacgccatgaaggggtaaagtgcaggctacgctagcaaatgtcagggtgagggtctctgcagctgaagaggatgcagcttcccgacagaaaaactaaggaagtgtggactatgtccctgggggcactggggtgaaaaccaggcaaacagctctgtcatcacacctaagggataaatgtggaggcaaaagagaagacaaagccaagagattcagtggcttaaaagtaaaaaaaaaaaaaaaaaagtaaatggcgtaaaaaccaaaggcaggagttttggttttgaaataccgttttattcatgataagttgaggtcacttttggcactctgaagatgatcaccaattgttatagcaaagattaaaaccaacaaaataacaaatacagcagttagaaagctaaagatcgtttcgtttcggttactgctactgttttataacttggttatgtaggttgtaggaatcagtgcaggggttagggtctgcagctttcgtcctgaaagactgaacaatcgaaagattttttgcatcatctaatataaatcctggagaaataagcttgacaaattgcatatgacaaaaaaaaaaaattcatgttccacagtggaagcagtcccctacctactctgactctacacacagtctgcatgtggttctgaccttggcccctctgctatgttctgggaaggggaagagagttggatgtggactgtggtagaaagaacaaagagattgcaaagctcctctgtggaagctctggggtggggctctgaaatctgacttttaaagaagagctccaggggaactgatacagctggtctttgattcaccctttcagaagcacagttccacacagccattggctggcaacaagttctgctcctaaactttaatccccagtttccaaacattatgtttataagaagtattggtagtaaccatgaggctagtttaattttcttttagtcctttatgaggccccagttctttttaaattaaccgtggcagaacccattggtcttcagtgtcaacataattcagaaaggaaacaagaggtgcacaaggaggaatgagatgtttaaaaatataattaaaaaataatagcaggaacatttacttagtacgtactaggtgtcagattctaagcgtttccatgtgtgaacacaaccacttataacaacgctgggagtacatactattattataaccagccccatgataccgatgagaagacaagcacagaaaggttaagcaacttccctgaagttacgcagtagcaagtggaaagcttgtctcaaaacaatgaaaatggaaaaggaacaaatgaaatgggaaacgggaattctcccccaaaggtatgctgtcttcagtcaatgtcatgttgtctctgtttcggtgctggtatttcttatttaatgtcacatttcaaattcataagagcacttttaaataaaatgttttctgctcagaaacaacttcaaagaaaatgagtgcaataaaacaaagacataggtcaggggcaaggtacccaacatgaaaagaaatagaaaattgcacctccccactttaagtaatttagcttcaaatgagccaaagtctcttgaaatcagatatcgtgtaggagatcccattccacactccaggaaaaaaccatagcaaacagtttaactgccacacatcagactacatccagtgcaatggtgtggtgttagtccacagcagttgttcccaaaatgaggagtgaggcagagtcaggactgcctggagagctgatggacagagaggtccagtttgggtaaagtggagcagggcctgggcctcagtatcttacaagttcctctttagtgattcatatgctcaccaaagtgagaaccactagtctggagggttctgggtccatgttcctccatttcttgaggaatcctgaagagaggaaactggtaactgatagggaagactccaggacagctggaacacttttagcagacacaagcttcaggtaccagagctacctcccacctcttcggtgtgtctgtccacagctctcgtcagccccacataggtgcaatttacttgtctgcattccaaatgtaagctctgtcttgcccagtgctgtgtctccagaatggaacccaatgtctacacacaataattataaaataaatattggttggataaatgaattgatggaaatctaccagcattaaaactatagaatgggagtgttgagagtagtattgaattgcccacaaatctaactccaaagagcctatagttcaagtattgaaatggttttgtaatataggcagctagagattacttcttttccataccacggaactgccgggatgactcattagtgatcctgaattctaagcctgcatcctctctttcagtgaagaacttggatacatatttaccccctagggtctcctgaacttcttcctaaaacatagattattctagtactcgcctaccgtataaggagtatttgaactaagcaattaatgacttgggcaccttaaaaaatgccaagcgcttttcaaacatctattatatggtcctgggcctaataatgctgctacagaatttctttcattgaattacacgttgtttaaatgtaaaagaatgaccttttaatcataaaacaaatgacttgctatcaattgaccaagagtaatattttcgcaacttgaaataatctggtctaaatcaccaaatacaaagaatgtatacaaaaatgttaccacattccctctgaacatggtttctactaaacaacagcacagttcccaacttgagtgccgtatcggcattgtggtccaccaatggtgaggctgcatagggggtgatgaaaggtgtgagcttaaaaacaacaagatctaagcttacttccagcttggtaagtcactgaactaaatgatattttggtttcctcaactctaacatggggaagataatcatatcttttttaatgggttatcagaaaaaaatcatgcatgagaagtattgagctcaattccttaacaaaataagtgctcagtaaatgtcacactactgttagcatcatccttggcatgtcagttggcatctaaggcttagatagaataaccagtctgtccctctgcttgttagccatttcccatcatatcacaatcccagctaagtcagttccatcctaatggcttaaacagttagggaaagcattctgtaaataatgacagttaaactagatcttagaagatgagcaagatagattaaagggccccagctttcacagtcattcaccgtccagtcagctgtggccaaggaggactggaattacccggagcagaacacgaatacctaagtgactttcctttgactggggacagtatccttcaagggaaactcataattttaacactcatgtatctagaaggccctgctgagctactctgacattcttaccagtcatcaagaatagttaactttccatacgctcttggtatgtatgtgtgcctgtgtgtgcaagtgtgtgcaatgaactaatagaaaattctggtagcccatccctttatattttacatagactcgaagaccttctttggatttgtagcagcaggaaacatttccgttttcaatatgggcctgccatctgtcggaaggctagcttctagagtaccacgttttctccactgctattttctaccacatggttatattctcagttttgctcacagcaccacatgcaataataattgctatttattgggtgcctctcatgagccaggcactttaaatgcagtctcttgaggtacatatgattatcccattttatagatgaagaactcaaaggctctgagaggttaggtaacttgcccaagttcttacagccgggaaagctgacctggagtttgaactgcaatctggttgatactatacaacaaggtccttttctctccccagtgcttgtggtagtatcattaaaggacattttgctttgaggtatgtttaatgcattttttcagtccagcatgttgtgttcacgtcacttcatttcgccacagccatataagcagaaattgcttaggaacctgctgtccctgggctgggcttacatccagctccacgctgtacagggggaagcagtgcttctattaaattaatgtgctccaacacgagtgcatcattccagtcacctgagaataggaaaagccttatcaagaacttgctattcattttaagctgctttaatcccctctggtctgatgcaaattcatttcattaataattaacagtgcttggcagtgctttccctcagtcccagttcttggttggcattccactttgctgaacctgagagaaatcagggtcaaaccaagggagaaaagaaaatgagagagccaggatctggcattaacccacccacctcgacccctatggagaaggcaaggtaactattgaagcaacagatattggcattatctgtgagttagtgtggatgatccttgtagttcgtcttcttaaatattacatctttaatgagctcatccaagctttgatagtgtggccttaaaccttgcttttgggcagatattatagatcagtggttctcagctttggctaggaatcggaatcacctctaagacttgaaaaaatacacataaaatctactaaagttgaacacttacatatcttatgacccagcaattccactcttagacttatgcccaacagaaatacacacatatgtgcaccaaatgatacatcagaacgttcaaggaagcacacagtagccccaaactggaagccacccaaatgcccatcaacaatggaatggaaaaatacatttgcacacaatggaataacatatagcataggattgaatagcatacaactacacacaacaatatagaatactctcacatatattgtactgagaataaaagccatacacaaaggagtatatgctacatgattctatccaaatgaagaatacagatatgcaaaactaacctacagggttagatgtcaggatactaattagtgttagggggattagtgattggaaggggcttctgggctgttggttatattctgtttttcttgatctgggcattagttctgtgggtgtgttcacgtgtaaaaattcaatctgtacacttatcatacatatacacctttctacatggttgttatcctctaattaaaagcttaaaatatgtacacataaacctattgcctccagtccagtaacctccgcaccgccccctcaacacacacgtatatacacacccactcacttctcctggggagcccaattcagcagccttgaggcccctataccctcttttaagctgctcaaattatttgatgctatcagtgtcatctcagtatccctagttttccctagccttccagcatttgcaataaacttcggtggtaaaacaatctaattccattaccatctgaatgatactaaaacgtgggaactgaaaaaaatcaaatcagtgtattgaacaaaaacataaacagaataatgtaaactgctcattttcaacttataaaaaagaagctgaggaagaacttgaacatttttgctacacaggcttaatgagtatgacatcacctgtcctttttaataataataactacgaagtaataatagctaacacatatgcaaggcactgctctaagtgatttacataaattaactcacttaatcctcataacaattacttgaaataggtattattattatccccatttggcaaatgaggaaactgaggtatagagcggagctagaaaaccatgatttcagattctaacagtatggcttcagagtttgtactcttaaccacttcactatattcctgtatattttatgctgcttaacatacttttcccattttaaatggactatatttaatatatttcaagtggtaagctaagtccacttgaatattggcatctcagctgaaaattacatgtgagatgactgaaatcaataatacaagttttatgtcagttcttcaagtgttggaagaaataggtcaaacatttaaaaaaaaaaaagccacgacctaaagaacatttctgtaagtgtcatccattcattggcaaacattgagtgagcaggtgctatgcttgtgcagtgggtccaatagtgacctcagtcaagggcaaggttcaggcccccaaagacctcctcattcagcagacagacacgggccaaacagcagaagagtgagtggaagttacacatgtgaccacaggtcatgaaagcgtataagaaagggaagcttcctactcaaaaaggtcaggaaaggcctcccggaagaagtgatgatggtgtgaaatatgaagaatgagtaggaggtaaaggcaaaggtgagtgggggtgtagaaagagctgcatatgcatgcgcaaataactgtaatgtaagtcagaatgaataaggactataataaacacacatacaaaaaagcacaatggaacttcaggaccttttttcctatttcattattcaaatcacctgaaatcgttatactttcagcatgaacccagaaactcttatatcagattcatagttggtctcacaagcctggaacacagtaagataaaaaccttgtggaaaaggaatttgaaacagtacttttaactcagcatatattgaaggattcaagacatcaaagtgaaaaaaggaaataatagtgtttaccttttctggaaaaaacgagcaacaaagaggaaaaaaggaaaaaccctcagatggtgaaatcaccagtcacagaagatattcttacaacactatataggtcagaacttccccactccccaccacctaccattgctgaggttaggcctactagaaaaataagagcaccctaatagaccaaaagacatcatgcaatagatgaggaatgtggttaagtacaacttctgaggctgcctgataggctcaaaataaatccaggtgcaaagaatgaatggtctttgcaaatctaagcctgctcctcaccacctcctggtataactatgatccaaactgttctctactctccaatataaaccaatgggatcttttgaaaatgtacatctttcatgggctacaccctccacctccacccaataacccttcaatggaacccattgcttgtaaggtaaaaacatagctccttaaagtagcctgagggtgttgcctggtctgctttccgccaacctctccaatcctatcttgtaccttgctcacttttcctctatatgtttccccaaaaacagccttctggccgggcgcagtggctcacgcctgtaatcccagcactttggggggccaaggcaggcggatcacctaaggtcaggagtttgagaccagcctggccaacatggcgaaaccttgtctgtactaaaaatacaaaaattagccgggcgtggtggcaggcacctgtaatcccagctactcaggaggctgaggcatgagaatcgcttgaacccacgaggcggaggttgcagtgagccgagattgcgccactgcactccagcatgggtgacagagcgagactccgtctcaaaaacaaacaaacaaacaaacaaaaacagcattctttcagtccctcatgttcaccgtgctccatgttacctcagggttttgcacatgctgcttcttctacctagaactctctgctcaacctgccctctacctagttgattcctactcagcctttagctcttggccccaatttcagacaggttatccctggttccctgactgtgtcaactctccccattacaagctcaggtaccttcccaccacggcacctgctataggtgaaattttacatatattgtcttgattatttgatcaatgtctcttagcttcttaaacgcaagggttggaattttgtctggttttaccgactttgtatccacagtcccaggcacacttgttgactcaaagtaggggcttcataaatgtccattgtacaaatcaaagcatttcatagagctcctcaattcctaggactgtctggttagcatattaccatatgcttcctggtcactctcataagcaccatgtataaagaagcattttttaaaaaaagtacatgtattatatccttgaaagaggcatgaaagagggcaaaaaaagttgaggatgatttgctactctagacaagcagcacatttctaattatcttggttacctaggagtaaagtatagtctcaagtcttacagtagaaatgagaaggaaagaaatatttagctgcttaaacctaatgttaagcaaaccatattccatctataactagatgcagtaggtttttcatttattcccaacatgtttgatgaatggttcaccctgataggagaaaacgctaagttcctactataaaggacaatgaaaggccaacgaggtaacattgggattccagaaggccctttactgcgaataatttacattttgaggctactgtttgtttttctcttttataaaattaaacataattatctgtactccatacctgtcccattgggagtttggaggaattaatgagatgatgtttgcggagtgctcagggcccctggaaacactattattagaacagttaagtaaaatgttgcttatggtaacctatggggtgacttccagacaagcaaggctgacatcagaataaaaaatagcaaagtgaaacaagaaggacaaaattactatttggtgattttacagtaatgaaaatcatccactttctgaatttctaactgcactctccaatccagtagccactagccccatatggctatttaatttaaaccgatgaactaaattttaaattaaattaaatttcttaaaattaaaatataaatagcctcatgaggccagtgctttctccattggatagttcagatatagactatttccatcatcacagaaaattctactggacggcagtatgaatctgagggggtcttttgactctttgtatctgaatcctgttatttgacactttcaaagcctcacccagagtagggatttggaactttatcagctagaagagagattactcatcgagctgaagagaaattattcttcaaagacaaatggtttcctttcaaacgcgttttgccttttctatgctgcctccgcctggttagcactaagaatatgtgcagtgtggaatgggttaaatgtttctcttttttccctatctcatatttctcagtgccccatctatatataagtgctgaagtctgggcagagagtaaaccatctgagtgaccatgaacacagattcataactaaaaacctgctatatctggttgcccacaaaataagagacaggtcattaatacattctcgttgggaacaaatcccctcttgtgtgaaatgctgctgcatctcatttttctctttatactattttaatcttgtgggattagggggtggggtggggaacagaaacgagcccagcgcattctaactttgtgtgggtgtctccctggcttggttaccaaagaaaccattatgttccatactattcaaataatggctctactagcgccctaaatactttcttcttttctaacctgactgcactgcagatttagagccaccatctgttggccagcaaaagagaagggtttctggaaatgtcacggcccttcccacactgtttgaagcctcagtctcaagactgcaacctaagaagtctgcttctgaagccaattatttccttaccaggcccaagacgctgtctccatgcaccactgcactgccaaactgcataagtgaaaggtatttgcaggcatcctgtgaggctgccaagcctcctgccacccatgctgccagcctcttctctcgctgcagttgtgagggccttgctgcttcacccctgaagcatgctgggggatctggctgggatgagtgcttccctgccaccctgggccctggagtgagtcacatcaccatcccatggatgcctattgctgatttacagagcaacaaatccagcagctgggaccacctgttttcatggctgccaggatgggttgtgcccttcagaggctcccgcggcaaagcagaagccgccagcccaggatgtgattgccccgggagagaggtgctggaaaaggacctggttttcacgctccactgccatttgcccttccctacccagtctttagatatacagaggtacaatgtacttggcaaattccctatgaattccaggcagccaggaactaaggaatgaggtgttcttgtaaacctccaggtctctgccacagacgattctgagttactctcccaagcagtgtggtcactctttctgaggttttacacaggaagttgaagggcttccaaatgtctcctgtctgggcatctaagtataaatctggtgaaattttgcagtctgttcaaccaaaagagtgttagtgattgcaacttaagaaccacgggctgggcgtggtggctcacgcctgtaatcccagcactttgggaggccaaggtggacggatcatttgaggtcaggagttcgagaccagcctggccaacatggtgaaaccctgtctctgctaaaaatacaaaaaattagctgggcttggtggcacgtgcctgtaatcccagctactcgggaggctgaggcaggagaatcacttgaaccctggaggcggagattgcagtgagccgagattctgccactgcattttagcctgggctacagagcaaaactctgtctcaaaagaaaaaaaaaagaacaaggaattattcttaagatcagtagttgcttccattaagaccaacatgcataccacatcttttctaacgcagtactttaagccaggagtctccaaactttcggggtcaagcatcctattcacatacaacatctttgcacgcctccaaatacacatatctctatttacaatgtgcatatatatatatagatataccttctaatatactactgtattatcacattacaaaacatgctcccaaaattgaaatcttaaaagcgttcaaatgaaaatgcaatatttttaaaattaggtttaattttgtttcatttattaaaggcacaaaagtcacttttactctcactggaaaaatctgacatttttaaggagagaaatattatcaaactagcgcttttattttttgatttagtttaatttagaggtattgtgctaaattcagtttcttttgatacttggtttttaaagctgtgacagcccccacaaaaagaaagagagagagcgagagagatcccacaaagacgcatagatccaaatggaacaagtgaggttattttacaacctcataatacctgtcataaaaaactaatatctgtataactatctgtgataacaacatgtgtaaaaaacatatatctgtatgctatatgagatacacacaaatataagacatatctgtatctacgtatatgtatatctatgtttctgtataagtgaatatgtccccattgggacatacactaaaaaattgtttacgtaaaaattcaaatttaactaggcctcctatactttatctggcaaccctaaactcgtgaagtttatttttttcttatttttttaaccataagtaaatataaataggagttctaatattttctttctgcatacttagcaatggagatcatttctaagaagctgccaccagagtccctggccaaaccagtgtcctcctcgaagagctaatacagccaaatgctaataagaaacccctcttcacttaagttccttaaaccgtcccctcctcaaaccctccttaccctgtagtagcatcgtgcatcaatgctatgactgactgatatagaaccttcttcatttttctggccaatacatttattcaaggaaagggaaaattacaggtaaagcagaaagaggcttgagccacatgtgtaggtacatgtgtcaactcgtccatctagattccgcctctggtttacagaggtggcagcaggagtactttacccttttcacctctaccactggcacccaagatctgctcaacattgaaagagatcacatgctaggaatacagtgattatggcctaaagagttctagagatgacatggttggaaaacgtgtctttgtgcatgtacactataaaattctgaatggtaaatttaacatgaccagaaaaatgatttatcactcatattttcctgcatactctggataagactgtccagcatcaacaaaacatggtaaaaaaaaaaaaacctctgagagagtcattggaagacaatacctgtggcagcacgatagatgatgccgtatcatgagtaatgaagtagccagcattaaataaagggttctagggaaccgtagggcaagaagatctacgtgatttcaatacgaacagttccaataacccatagcattgtgagtactatcacctcttgctacctctttctcatgaagggtagggggcaaggtaatattatccagtgcatttaacagtaaaaacaaaacaaaacaaaataaaacactaatagatggtacctagacctgaacaagaagacatgatggctggacgtgacaaagaatcctcatgtgcatcgatgtggcaataaacacatatgcaaatactgcatctctacctattattctaaatcttcatcaataaaatgttaaacctctcattggtacatgaatttttgtgatacatttttaattgaactgcttacataaatagaggccccacaccaaatatttgccagcggccttgcacaccataggggcagccctagtgctaagctgtgcaacagttctcctgtgctgctccaatatgcaatttcacaataacacatggtctcaggacattctcctgggcaaggtcattttcatggtaaggcctaacaattatcgagtgccaactctgtgtttggcactctactcggggctttacatacattatcttgtcttgtacttgtattaaaccaagagaaataataaattgctttattttaagccactaagtctcagaatagtttgttaagcagcaatatattattgaaaaacaataagctgagatttttttcgttgctcgattcatttcctctaaactactgtggagcaggcagatctcagacttttctatctccctttcacaactgcagaaattgagtagcagcaaggaaggggaggaagatggacaagagcaggccaatagctttcccctgaggaggtgtgaaggctgcagaaccagaataaaaggcctgtcctcccagattagatccagggcctgacctcccaagcatcttgcctcactaacaactgggggcatttctgaagtaaatggacagcccagggatgtgtgaccctgaaagcacaacatgtccagaccaggaaaaaaaaaaatgccttccttttcctggaagtggagatgtcacaccctatctggggtcatctgctcaagatctcagcatcgcttgctgccagctcccttcagatagagaatgctggacacagcttttctccccttcatcatttgacctctaccaagacaatctaggaaactcatcattagtgccagaagcaggaaaatgggagccatctcctgacaagttcacaccagacaaaatgttccagcttgacaagagacgggggagaatcaggaactttgtcctctctcctccttgttaattagtccttggttttgaatttcagggagaggtacaagagacaggtaataaagaacatacataaagcatatggtatgttagatcatgataaggaacacgggaaaatatgaagcaggaagagggtaaaaggagcgcactttgggtagtgtttaaataaggtgatcaaagaaggcctagcacacagcatttaccaaacttatctaatcaaagaaactgtcacagagcgtgtcacagaagttaggaaatgctgtttcaaaaagtagtttcagctagggaggagaagcagattaattagcaattgtattaatatttggctactagtaagaaaaatgtaagtggtttacacaagatagaagtttctttttcatttgcataaaaaaagtgtggaccaggcaatccagggatgcaggacacctccatgttgtcatcagggacttgagttccttttacctttctccccaccctgctgagttcttggcttccatcctcaagcttgccgcagcccaggatttatctttatctccagccatcacatgtatgttccaagcagaactgtgcctcttacagagtctgctcataagtcccacccaacatgttttgcctatatctcattggccactctccagctggaagggaggctaggaaggcactttagccagaatatgacctctcataataagattaagttaattagtcttagtcttgctaagtaattgctgatggcaattagcaatttgcctcgggaaagaaggagggtgtagtggaagggacatccctgcgtaccagagtgcagctttctattttgacacagcagattgcaaagctgctcacacatcagtcctgcagctgcaccgtccatgtttcttatgagaacctagggttaaaacgtcgtagaacacagaccccagcagcaaaatcactatactcccgtcttctggggcaatgtgccacccagctcctgttttgtccattcaccacatggcagccagaatgccattttaataatgtaaagccagttatgtcactttcctacctaaaactctcatcacacttggaatgaaatccaaacaccacgagatggacgcagcccatctttgactgcttcttcaccactcctcccctttgctcaggactccagccacgctggcctttttgttacatgaacacagcaaggtcattcccaccttagagcttttatctggaatgttctttcccacatggctggatccttcttatcatccagctcgccactaaaatatctcacttcctcagcaagactttcttgacttactccagctaatgaagttccgcccctaccagatagcccctagcacctcattttattttcttcatgaatttataactagttcaatttaacatgctcacgcattttttcccttgttcattatcaccattattaagttccatgaaggcagaaacactgctgcttttgttctccccatacctccagcccacagtgaataaaacgtggaaggctttcaatgctgtggaatgaatgatatggtttgaagtgtccccattctcttagtcactcctccccaaacacccttcagtttggtagacgacatcataaacagactccaagaaacactacccaattcctagaagtgcatcattaacaaagagcagtattgtgctcttggacattatgtaatgtcccctgtcctggctcagtggctgatttcgatgtgtttttgcatgtggattcatggatccattttgagaattttcaggaatgggagccctcaggtcagaaatcactgccccatagaattccatgtgatgatgtgggaccatgaatcaaggcccctacagctcagcaaccctcagtctccccaaaaccaatttgaaatgcccaagtatgtactggggacacctcaaagccaaaatgtttactacataaccattcttctaattttaatggtgagtttctgttttaagaaacaatctagaagagttcagactttttattgcatattattccaatttaagggaggtaatacagagactactatgcattcacaaagcaccatttttttttcctcctgagcatacagctggattacagttaggagtggttatgtcattgagtctagccaatgaaatctgggcgaaagcgatctataccacatgatggacagggactggatccctgaaggactgagtggaatagaatcacccacattccctatctgagttaaaatctgacatgaacaataaataaactctcattgtattaagccactgagatttttggaattgtttgttatgacaccgatcctaccttgactcatacagaggaataaaataaagaccctgtcataataataatgttaaattttcaaagaaaagacaattcagcttcctgcaatctcagccattttgtgctgttacaaattatgtggttttaacatcagtggaagactagcaaaaagcttgcggcttcttagatgacataaacatactgtatttgcttttcaagtgctggaaatgtttctaactaaaacatgaaagcaatattttaacaggctgacttggggaaaatgctcaacatgaaaagaccaaaatgtttttcaaaaagggaaacaactcaatatgctcccaaaaccctgcccaggctttaatcaagggacatccaaagggaagcaaaatggctggacttagtctgaaagttatgagaaattttctggtaagggtaggatactatttagttatcatttaatttaatatttacttctaaaggtattttttaaattaaggaagctatccaaaatctttatcctgggaacatgcttttatccttaaaaaaataaataaataaataaaaatagcctccttgggattcacaggatcaaacgcaatcactcttttacgtggccacactttacctatttcttgctaacatggcatattcagcccattatatcttcgtaaagaattggaagacatttctgtagaatttcagtttttcttaaattgacttcgtttccatatatttagtagtaataataataataaataatagtcataatagtatctttagtgcacaccagaattggaaaaaaaggtttcatatccattatcaagagttctagtgcttgataatactctaaaccatttatttctgtattccatgtgtgacatttgtaaaattgtaagttcacaacttcctaatgtttcctggactaccacagccctatacactaatcatatacagtagttagtatgtattagaatgtcttttattcataaaatatggatgtattttcccagaacaaaagtattaattattgttaacaacaatttaacttgcaatatcttttaaaaatacattcaccacatttctgcagcttcaaaaatcctttgctgtacttctcactttttttttttttctcttgtccagcagtatcaagtttccaggtttcagggctctggtttgaaatccacagcctgcaaatgttttaaataaagcagaaccatataaaaagattaaatggatacagacaagaaagttaccttcgggtggtgtcattgcttttctgattagtgttcatttggcttttccaaatttttgcattgagtttataatttgttttatgtgtaaagtaaaaaataaataattaaacagaaagcacttcttttagtcacctagctttgggtacacagttacatcttaattcattttgcttcatttggttttagtaatcccttatcctctactcctgctgaaaacaagtgatacagtaaactgcactgtgtcaagcagaattcttcttcctctttcaaagaagactgtctagaaatgaacaattttttcaaggcacctgtttcctttcaacgggaatgacagataaagtttgattgagagaaatgccaatcatgtcatgaggcagatggattaactttctaacgtttctttcccgacagtaaatctcaacttttactcctatgcttagcaaaatatttttagaaatattgtttattcaatacagatgatgcattttactacttcttagagcaaaccattgatccctatcaccatggcattaggtaggccccacaaatcatccaggcatctgccctcagtctcaaataaatcacgacagagcagtaaagaaaagggaaatgtcaatcggaactaggcagtcaataggaaaagatttttcagtgtctctatttatgacatttcctttcacttaaagacattggttattctaatttttggttttttttgcaatttcctcttgagaacttctcccataaactatattttagcacagtacgaattttcccagctggtatttttgagttcttaaaaaatcctatagagattcatactaaatatcatctacagtaaattttaaaatgataggttatgggttgggcaagatggctcacgcctgtaatcccagcaatttgggaggctgaggcgggtggatcacaaggtcaggagttggaggccagcctggccaacatggtgaaaccccatctctactaaaaatacaaaaaattagcagggcttggtggcgggcgcctgtaatcccagctacttgggaggctgaggcaggagaattgtttgaacccaggaggtagaggttgcagtaagctgagatcgcgccattgcactctagcctgggtgacagagcaagactccatctcaaaaaaaaataataaaatgataggttaagcaattataaaatgtataaactttacataaaagtgcaaacacacatatcggtatttattgatttaattttgaagttcctatctttaaaaagtatcagttccccaacttaaaaattctcatctactttgtttacattcattttattatcagggaggcctgaatgaaattctttctgggatatttcattatcttgtttatattttatatgttacgtgctgttgtgttatattactatataattttatatatttaacttaatatttaattaatattaatttaatggtaagatagtctttcctatttcaaaattccaatctcatatttgattcaaagtcttcatccaagccaggtgtaatagtggtaccagaggcctggagcagaggtgagaccaaagtgaggggagcttctatctcacacacttaccttcttttcttctcagactcctctgaattgaaggtggtggggagggataagagaaataattttttttcatgtcttccctctgctttattggttataattccaatcatcttatgcaatagtggcaatggtagtaaggtcaccatcccttttctattggcgtcactgttgtcctgtctaactctgactgccctgggttccctctgagaggcaagaattaaaatgctggctctctgaggggaaagagcatattaattcttcaaaggttcgcatgggaggcctcccctgaatagcaccctggaatggaagatccagctgaagttggcttcgttcttgcccctcctcagcaccctccccatggtgacttgctgatgggactccctcaacaaactagcagccctcttaggggtataatcaagagaatttcatctctagccaccttctgtagtaaccacttaggcacaagagactgccatactctggccatgccaaagagtggtaatgctcacacatctaacgctctacctcttagttcttaacgcctcaccctagactgtcagacaggagataatcttactccctgatttagggcagaggggttgcgacacttctccagcctcaatcttgtacaaagaaggaggtagacgagttagataaatctctttgtcaaccgaaactttgacatcttggaacattgaacttgatttctggctgcctaatctgtggggtatctctaagggaatgagagcaatcccttatttgaaaaaaaaaaaaaaaaccaacacaactactgtattctgtacagataattccggccatcccatccagaaaaatattgctgaccttttggacatcagcaccgcaaaaaacagaacccagagcattttttgctcacaacgttttatctaagacaaacacagaaacagctatgtgtaattcaggtagcacacgcttagagaatataaacaaattgagccaaattatctgcaaaataagaagcttttaattattctatataacttgattctgaaccccactccatagccccttgggaagacacttggtaaaatatgtgttaatactttgctccagaagcaggtctgggaaaccccaaaagtggtccaacatttgagattctaatcacaaatgctgtggaaaatacccatttaaagagtaacttgaagtgggctaagcaaatacgccctccccaaaacacacatactatctatagatagatatatacactctgtctatattaaaatatatattgacaacacacactatatatatagtgtgtatgtgatatgtttatttacaacagttaataattttctgtttattaacaacaattctctaatgggattctgtgtttttacttttttataccattgtatattttcaaatttctacaatgaatatattgataataagatgaacgatggcattgattaaagtattacatttgccaagctcaatgataaacttctatacatatagctagtttaaacctcaaaacaggacaatgagatagaaactatgactaacttcattttaaagatggaaaaactagtacctagaggttcttcattgcacagcgaggaagacagaacaattaacaggtggcatagccaccatgtaagttcatgtcaatctgactctacatttgtgttctttccactataccatgtgacataactgaagtgcaagatccttagtgggaccacagatcagaagtggctcaatcataatcagcacacccaggaggtttattctcatgacatgggatgtaaaatagcactctccactagaagtcaaacaggaaataagcagaggagacgaagattaggtgtctgaaaagtcagctttgtttctcctacaaagcacataaagcaatgtacagtgaagggaggggagcaatttgggtatagactcgagactatactaaagcatggctgtggagaaaagatcaattcaggaaagcctcgccaatcagaggtccaacctgcagctgcctcagccagttgtaacacagggaaccccaaaatttgtttaaaggacttccagcagcatatatgccccaaaaagctgggaacttaatcatattagaaatatgtagtgacaccactggcctcctccaaatgactaagtttgcagagaatggcagaagattacaaatagcaacacactgacagccagtgaaagtccaccaggggcaaaggaacatgagatcaacagaacaggtggaagaattgttcaagtggagcagttgggcaacgggtggacatcagtgaaagggtcacctgagttctccatatttcaatagttcccaaagacatcactgcaaggcagcacaatagacaaacaacattagaacaagaaagaatagaagtcactggaggtaccctagatcctaccttgttttacagctaacttgatgaaaggagaaaactgttgccactcagaattacaaccctgagtcattaagaagcagtgattttctcaaagtattatgtttaaaatggttacacaaaaagcaaaaataagcctaatggcatttacacacaccaatttctattttgtgaaaaaacattattttgtaaaatatcttgtgctctgatgaggtcagacatatgagtctacggtgaagcctggtaataatattagtagaggacatttagctttttcaaagtctaccatctctttttatcgtcacacttttcatatgagattgccagggcacggatttgatataattatcttcactttatagatttgtctcagtgaagccacttaagattggcagagccactgttaaaacctaggtctcctaatgcacaactctgggcattttcttctgtgtttcactgcccaataactcctttgggtggggacagggaaatgctaggaaattaaatgagtatctgaggacagctggctatgcaatactatgtgtgcattcattcattcaacaagtatgcattaagcatctgaatcagttagctattgccacaaaaataccaccctgccaaaaaagacacccccaaacgacgtagctttaaacaagtcattatactgtcacagatttgtgtgtttgatgaaagttaactaatttaggatggactcagctgagtaactctgctgatctcagctgggagtgagctgatctggcctggcttggccgtggtggttcagctccgttccacatgtctgtcatcctcctcctgggactagaaggtgagcccagtcctgcacctctcatggcaacagcagaggcacaagaaggaaagcgtcattttcaggtgctttctaaactttggttctgccttttaagcctctggcctgctaacattccattggccaaagcaagtcacatagccaaactcaaaaccaagaggcaagaacacagaatctgtctctttaatgggacaaactgcagagtcagatagcaaaggatgtggataggagggagtgaagaattgggaccattaatgctgccaacatctaccatggtccaggcactgtgcaaagcactgaggaagcagtcccaaccataacagaagctggcctcctgaagcttacagtcaaaaacaatgattaaacatccatgcttatgaattccactgcagcctgctataactgtaacaacatttaataatgaaagtaaatctgctacccccattatattttgcatttctggaaggaatatgtgctttgaggggttatccattattttgaactctcttcacactgcttcccttctattgtcacacattatcaagatgatctcatatgacgtatttgttcaagtgaataatggtatttatttagaggaccaatgaaatagcacttctctgctgttttggctgcatgttagtgtgagatccagcaggtaggatggaaaaattctcaccttaagaagctaaagatccacattccaggtctccaccccatataagcatcctgacaataaacctgtttacatcacaggagttgttacttaactcaaaaacatttactgagagccatctatgtaccaggctcagtgatcagggtttttccatctaatgactcatctaataggataaccttgtgagtaaaactactgcaagacttatcccatattcaacaaatggttattaaagcacaattatatgccagccactcggtctgccagatgagaaatatatatttctggccctccagaagtacacatcctattaagagacagacctgtaaacaatataattaaaatataatgaggtaagtgcctttataggagacaatgcactttcaaacattaggcaaatataaggcattataattaagcatagctgtaggtctcaaagacctcatcctgttttcagaagggcgtaatttacctgcaaggaagtctgtggtactgagacaatttgaactggatggaggaataccctgattccaaaaccatatgccatcaccgtttccactttctgagaaaatatgattaaaaggaaaagtaaaagcatgatgcttgccagccaagcagataaatgacagtcttgaggattcaggtgcagactcaagaaacttacgtgcccaggacagggaataagaaaagagcagtgaaaattccaaaaagctcagagattgagagaactcaggtcataaacctaaaataaaagaaagtggaacatggggtgaccttttctgggcgtcggttctaacttccttgataggaaatcaatgtccattccagacacaaaataagagtttatcacctccagcactttacaaatacttgcttaaacaaccaaccaacctatatatttatcccccctataaatttttccctcctctacttctttctttccttccccaaatatttcctaaaggaagcatgctaattgctggaaggtacatgataacatcagccactgaatcagcttatcttatcaaaaacttttactgacaaatgttcaatgtttttaataaagcacataccctcggacataaaaggagttaattatcacaaacttcaaacccctataaagcccaatcactgatgattagaaatgttacttagtatatcagtgccacaatctcagtactgctttcattaaatgactttgccaaagttatgaaaccttcataattccatgaaaaatgggtgtttctaacaatactatgtataattaagcatacactgctgtgcagttggaaaattccattgtcacctgcatcagcctcaaagatcaatttgcatacatggatcaaagagaatcttacagcttgctggttcatttcaaagacaactgggaggattttaagaccttagtacatcctcaaattaatcagaataagaatgtttttacttgtaaacagccaagtatttcataagggattatatgggaaatgcatttatctattgcttgagtttaacttttctgataagtgtgctttcattacttctctctctcaagcctcaagattcttaaatcttcttcaaattaatgatatattttaaagtcaaatcaaaattatattattccggccaggtgcggtggctcacgcctgtaatcccagcactttgggaggccgagctggatggatcacctgaggtcacgagttcgagaccagtctggccaacagggtgaaaccccgtctctactaaaaatacaaaaattagccaggcgtgatggcgggcgcctgtaatcccagctactcgggaggctgaggcaggagaatcacttgaacccgggaggcagaggttgcagtgagcggagatcacgccactgcactccagcctgggcaacagagagagactctatctcaaaacaaaaagaaattatactattccattccatttaacatgcagggtttcagtgggtcctccggaagtgcaagactggagaaaatactgctgacatgaagtagcaactaaagtcctctcacctgcattttgtgcaacgtctttgcccgtttggaagccaaggcttccaataggccaggttgtataggccaggcagaataggccaggctgaatagtaatggaaagtagaaactaaggcaaaggacaaagaaagacccactcccattggtgaccgggcatcactgcgatgttccattacctattgtctctcagctccaagcccaccatcctatactctcccctgtgatcctagagctgagactctgcaagccatgtttctctgagtcccttgctagctggcttcctgtccagttccaccatcaggagattgaatgaatgtggaggatctcccagaggagtgtggctggatggggaaagggacttcccacttctttcccagtttctgtcagcatgtctctaatagcagcctcactttacaccctcagaggtgccagcggcagctggaggaccagccatctgtgctccctaactcactgggccatgccatctgggctactggagcacccactagatcacccactcgttggcctacgtaccagaggcagggcacctactccacaaaggtgcagtcaccagccccagaagggcccttccccaaactcctggattctaaaacagcacattttccctcttgttctcccagcccaggggcattgcttcctgcaattattatctccggctccctcagcttcccttttgctctttagccttccaatgctggtgtagccaattcctgtgttaaatcccttctgtttaaattcccagtgtatcttcttttttttcttaactagatcctgactgatatattcatccaggcagtgatgctcaatgaagaaaaagtggatttttccattgctggtgagagattggggaaaggatcaatatgctgtttttagaagctgtagaggtgattttgataatacctcagttccctgccattgttctttcttatccttcgcccgcaacatggttttccagccatcttacaaggtcatactgggtacaactaaaggtggcaccagtggaggaaatacacacagtttgacttctgatggttcaacttatgatttttcaactctagaatggtgtgaaggtgatatgaattcaatagaatccataatttgagtatccatatgaccattctgtttttcactttcagtacaaatattcaataaattacatgagatattcaatactttattataaaataggctttgtgttacatgattttgctcagctataggctaatggaagtattctgaggacatttaaggtaggctaggctaagctatgctgtttggtaggttaggtaaattaaatgtattttcccctaaaccatattttccacttaggatgggtttatcaggatgtaactccattgtaagttgaggagcacctggatatgagagtctacaaggagtccctttatccattaaccccccgggtaatccacctattgcatgtgtcaataatggtgatttgaaatgatgctaggccaggtacaaccacacctcactcaccatgccttttgaaggctgcccccacctgccagttaagggaggtggcacataaggtaccaaccgtcgtaggaattaaaggccacccatataatcgtgcttatactctgacatgaggacatagtcaatactacaaaggggaaaaataagcagaactttagcccacagcttaggaaaaggttcccagcccttgatatttaacaacctcatcggtaattgcactccagaaaatagcactacacgctttcactgcagcacagaccacagcccagaaataaattcaagctaaaagagtcatttagaaaactggatattctttcagggtattcacacaagaatatcataattatgtgttatatctgtagagtatctttatttctctagtgtgttcgctgtgttgtatttcaattaaatattaaccaatgaatctttcaggaaatataaaaagatgattccctaggtaaataactttagtttttaaaaaagaacacttctaaaaattattaatgcaatgcatcaaagtgagcatttgaaaactaaactcaggcagatgtcgactgcagcatttagccccctttctgagcatcactaggcccctcatgcccagagctaatacgacctcaagaaaatgaagccagtctttgactcagtgatttagaggtggtaggggaagttgggaataaatgctaatggttttcagtcaaacccaaagcaaaacacaagccagtcaaagtaaatattttgtcttacgcttccagttgacatttgtacgtcaggataaggccttaccctgaaaaataattttttcagttaacagcccttgctttagtttacctttttgcggggaaaaaaacacatatatgcatacaaaggaaatgaagcataagacaaatgtttcacaatagttctatttgatttaccagttccttaggctagttgctggttcatcttaaattctagtcctcagcaccccacccagcctccaccacacacaacaggcatcctcctcacacatctgaagcttttcacatcagtatttcctccagtatttaccgctattcatctcaactcttctgtacaattcacctttcaagtagggccagtaccataaaccctaatttatagagcaatttgcattcagtgtaaccgctcttcagttacagcaaacaggcagaaaaaaggttttttgatcaatttgtcagttgaaatctgtttatatcttccctgtcaactgtgggaaagctgtatgtaaagtacacaaatgtaatcatgtatattttctgatgattgttttgtgatatctttgacatttgttaaatcttccccccaaaatcctgttagtttatctatagaacaagaaaggggctagtgttgggtgacatatctgtttccatacaggccacgttctttcttaatttctctactggtttgtacttgttgaagataagcatgtgtcctgaacatttattatatgttatacgtcctgtagatctgcctgaattgtcactgcttggaactgtaagcctcaaaggaacaaattttttggccattcctggcatggtggcagatacacagagatcctcagtatggcagattctgttggtgccctatctacaccctcttgctgctatttgttctcttaaacacttatggcttttgagaaaaacctttgtgactccctgcctgaaggttctgtctagccacaggaacatgctctgtgtgcacgtggggcaggctgaaagggccaagaatcaacatccctcctccagcggctgtcaaccaatgaaggatggaagtgtttggatacataccccagcttcctcacctcttaggtggggcaactctgaagcatgttgtatacaatatcccagaggtccacataataggactgagagtcagtcacccacaaaggtaaccctatcggtaacgtgcctgtattggcttccttctcttacctatctcacttcccacctcttttctcagtgcatcctggaatcacctcccaaataaaatatttatattcatgtttcacctcaaagtcagcttatgagggaccccatcccacaactagtcaacaaatattttcagtgatgtgcataggtttttctgccctacaaacttgatttttttttttttttttttttgagacagggtctcactctgtcacccaggctggagtgcagtggctcgatctcagctcgctgcaacttctgcctcccgggttcaagcaatcctcccaccttagtctccccagtagctgggactacaggggtgcaccactatgcccggctaatttttatattttttggtagagacggggtttcaccatgttggccaggcttgtctcaaactcctgacagctgatccacccgcctcggcctcccaaagtgttcggattacaggcgtgagtcactgcacccagcctgccctacaaacttgaaatacgaaaggtctcatatttggcaatgtggcaacaaaaaaaatgaccttggagctttgtcttcaaaacacaccaccagttcccttatagaaagtgtaggcaggcaccaaaatttactacatattattactaatcaaaacacacttttgacccacaggccagtgaagcaattgataatgaaaaaccttgatgaaattggggcctgagccagtggaatttagtcaactgccccattcgactccccgccctcaccacatcccagcacccaacacagacattggtaatgctgcctagacaaatggtcccaactcctcaaaccatgtatcaattaatagtcaggaattaacacagaagcagaggaggctcacataaacaacaatccaagattccaaccatttctgtgtgggcattttgatgttattgaaaccactgcatagtcctaaggccacataacaggaaagcacactgaggccatgaggtggcagagagtgaccgcttgactggattcagcaccaagaacccagcttggaaggggacagtcactcagagtcctctgggaagctgccattggaatttgtccccagctaccgaccgctcatgatgaaaaaagaagtgtcctcccttgggctcattcaacaaatattaccaagccagttacgcactgaggattcaatggtgaacaaaacagaccctatcccacctttgcggagcttacagcttagtgtagaagacagatattaagtaaggaaatgcccacaaaacagtaaatgcctacaaagatgaagggtaaagggaaatctaaacaatatgaggaataagaagttctcagtgcaaagggaaaatataaggggcaggccagaagaaatagcacgtgtgaaggcagggaatgtgagattttaaaggaacaagaaaattggctaaaaaccgtaaccaatatggctaaggtcgggagagagagagaaaaggcagggggaggacttagaacactgtctgacacatagctagtgtacaatacacattagctattgagggactcttgagaaaagcctgcccttccttaaatgaaactccaacttggggtaaatcttcacaactccaatattatgctagaaatgctactgcctacttgatggtcattaagtaaattaaaattgtccactgatttaacagtggatctcaaacctagcttctcattagaaatacatggggagctttttaaaaatactgtttcttgtaaagattagcctcaaccatccagactgaatgcaggagcagatatgagaatccagctgtcttctattaagccaaacattaaagaaatttggagaaatataaaatgataccactcttttcacgatttattttttattttggaaaacatattttaaaataaatatttatgttaatatgttaaaaaatactgcttctttgacatcccctctccacccaaccaactaaatcagaaaccttaggagatggagcctgagtatttaaatttccccagctgctcttacatgcggccagctttgagaaccaggacaacatttcaacatgaactagtttattagtgaacagctagccagcctgtcactaagccaggccccagctgggatacaagaaaggtaaattaaaatttaagtctgggctgggcacggtggatcaaacctgtaatcccaacactttgggaggccaaggtgggaggatcacttgaggtcaggagttcgagaccagcctgaccaacatggtggaacccccgtctctactaaaaatacaaaaaattagccaggtgtggtgacacacgcctgttaattccagctactcatgaggctgaggcaggagaatcacttgaacccgggaggcagaggttgcagtgggtcgagattgcaccactgcactccagcctgggcaacagagcaagactccgtctcaaaaaaaaaaaaaataataataataataataaatagtaataataaaataaaaaataaaatttaagtctggatgagtttactgagagcctgctctagggtagacacttttcattcactgtgttatttggtctccaaaaattctataacgcaatttcatcccatttcatagacagcaaacaattggtatccagagaagcaggttttctagatcatacaacaaacaaacgggggaagcaggatttaagagctagtcgttttgcattccaaaccctaccctctatctgctacctcatagagctttctaagaaagtggtgaatggttgcagcccttgggaacttaaaaaaaaaaaaaggaaattagagactgaaaaagtggtgggattgagaaggctccaagggagaagtatcagaggacataagacagacttcacataacctgacattttccccacagacagagctgctaggtatggcagacctctgggtacccatcgctcacccagaaacttctccccacgttgctggggagtcatccttgataccttgctttcttttatgtcccacatctaattcatcagtaagtgctattctatgcctctaaaccatctccagaatctgaccacttctcaatatacgcacagctacaaccctcgtcttacagactaaatgtttgtccccacccccaaattcacgtgttgaagccctttccccccaatgtgatggtattaggaggtggggcctctgggaggtgactaggttttgatgaggttttgaaggtgggaacctcatgatgggatgagtgtccttataaggagaggaagagacctcagagccctctctctctctccatcaggtgaggagtcaatgagaaggtggccatctgcaaaccaggaactgaatctgccagcaccttgattttagacctctcagcctctagaactgtgagaaatgaatgtctatcgttaacgccaccaaaaatatggtattttgttatagcagtccgagttgactaggacacccagtccaagtcaccgcaagtcctcattgggctgactatcttcgcctcccttgtactcttgctcccagacagtctctcctcacacagcggcaagagttatcaagggaaaaagaaatcagagcatgctgatcaagcaggctgcttctcttcaaaccttctaacaacttcccatttcaaccagaccaaaatccctactcctccgtggccctctgagctctgggactgcctatttctccagctccgtcacctgccgtgttccctctcatgcacactggccttctcccatccctcaccatttgctgctatgtcggggcattcctacactccattctctctaactggagtgctttcacccagatctttgcatggcagcctgcttttcattttgctctcaactccaacttcacctccccagagaggccttgcctgaccatcatagctaaaagagacccccttcctctccttgctagtcatgtgctagacactcaataatcacttgcttactggtaggcatgctttttcaaaagtgtaactaactgcatccatggccagaaggattgtgattctttagttggaaattctattcatcacaccctgacatgctcttcagccttgaacccatggctagttctcttttctgttcgcaaaatgagaataatgattaacatgagtcttgaggcgaccttctgaccgagggctcgatgtgggttagtaattagactcccagtgccatatccagaaagagggagaacccagagccaaatccttttcttgcgccttttcctttgcatttgatgttggcttttcatttagaacattcagggaggaggcaaataaatattacattggctgacactgtgtgaatgctcatcacatccagtcagggcagaaaggctggaagcaaaccattacgagaaaccctcataggcttggaccagactctaagtccattaatctcctgcaagataaccaagtccactgtcaataaaaaattaacgacaccatttcctgagcttggcactatctaagagtccaaacagacccaggaaatggagtgtagcttctactccagatccttcatgaaaaaaagggatattgcccaggacaaatgacagagctgcctccatggtgagtgtccagtcttctgcctgccctccctaattgcaacactgatctgctgttatatagtcccctcttttctcctctctgtagccagaagctctaaacttgtagaccctcatgaggcctgtgcgtagaattcaggagtctctaacttggatgggaaacttttacttttgttccctctaatctctaactgaaatgtggcatttcctttaaatcaacgtaggtaacaaactgcagcaccactagcagtgcctgtgactttgtcgccaataaaattcagttattttcatatcacatttcagttgttgcagatatctcaaaatcctgttaacactcacactacttcaaaagtactgaagttattacaactgttgttacatcttgttattaacatgttaataaagaagcacctgtattactgtttcacaaacctgtttttaaaatatattttggtagctgtattttgatatgattgatttcctttgttatccagtatattttatattatgcttttaaaaacacttcctgagagggaattcataggcttcaccaaccttccaaagctgtgcctggcaccagaaagactaagaatacctgccctagttcccacctttggtcacatggcaaagtggccaagtcttctcactgatgtacaagagaagtttccatctgaggcaacttgcaattcagacaaggtttgtcgtctaacctgtctccacgcgacgccccactctgccctgcctcactgtccctagcagtgtttcttagcttttgtaggccatgctgccctttaataaacatttatgcccacctttaatgctctctgaaatgcaaaatcaacactgtgattaaaaaccactcaatagtcagaaagaatgaataagacctactatttgataacacaacacggtgactatactcaatactaactgtacattttaaaataacttaaagagtgtaattggattgttggcaactcaatggataaatgcttgaggggatggataccccatttttcatgatgtgcttatttcacatagcgtgcctgtatcaaaacatctcctgtactccataaatatatatacctactatgtacccacaaatttttcttttaattattaaaaaaccactaagtagggcaaagtatttctttatgttaaatccccacatgtcaacttcaccagaaatttcgattccccaatctcactagcaactgtggctgagaatcacttctgaatgaatcacttctttttttttttttgagatggagtttcactcttgttaccaggctggagtgcaatggcgcgatctcagctcaccgcaacctccgcctcctgggttcaagtgattctcctgcttcagcctcccgagtagctgggattacagacatgcgccaccacgcccagctaattttgtattcttagtagagacggggtttctccatgttgatcaggctggtctcgaactcccgacctcaggtgatcccacccgtctcagcctccgaaagtgctgggattacaggcatgagccaccgcgcccggcctgaatgaatcacttctaaatgaattctactgagaggacagtagaaaccactcgtgttcttggttacctcctaggtatttacctgactaactgtcccattcctaccagtatcccaggctaggatgggttgacttctattcctagactgagatgtaaggatgagggtctagattggcatggggtgggcaatttccctttctcttttagttctgagataacaagcatggcgtttctggaaaacaagtttaccaagacactaaagggaaaggcagaaaccatgtagaaaatacagaagtctgaaatcaagcttgtcttcagagaacagatttcttatcccagggtgactccagtctggcttaacactggcctggcactcatcactgggcactcaagcccctgttattttcttcctctctaactgggatgtgagacttggcaactctaaaccctatccagagggagttcacggttggcacagctgctaggcctggcaggaatctcaggcccttccaatgtcagcttcctgaattctctccaggtgtgggcagggtgagaagaaaagaggccaatggtaaaatccgagaaaaagctaacatatgagaggcagggagaggatatggatccacggaagggatagagaaagaacgatagtggagaagagctaccccaaagaatcatgaaatgagcaccgtgtgtgggcccagctgagtggccttctctttggctcccccttgagggcacctcctggtactgcacctagccccggacccccagcctaggccacaagtaaccctggcacccctacgagacaaacatacacaaacacacatacacgcacacacattcctgcctggtcctccaaacactcatttccaacctccttctcccttctctgagaagctgaaaaagctaatcttctcccaatgtctcttgagtgtaggagtggccatgtgctaccagtctgaccactcagatataaaaggaaatttactggagtggtactggagaaaatattacgtttccttattaaaggaacagacacaactttccccttccctcatgtcttaaatacagacctgatgtgtctagaactgtaacagttatattttgaacagaggcaatgaccgtggtgggaaggccacagggatggcagggatgccagccctgacatttttgagccattgaaccaataccaccagacattgggctatgcagggaaaggcaatccttttttgttaaagcaattcttagttaggtttcattacttgcagacaaaagcattcctaactcatataccagaatagtcctttcataccaatatctcttcatcaactcaaagtagccaactacccgcttcccatacccatcttctatgagatacctctccatagcaaccccttaacacacacacatactgctgactcaggtgacaccatttagacagcaatactaactatcagattcaatgtcaagcccttctcttctggctaattatatcttgctctgaccatactagaccccaagcttgtctcataaccagaactccctacagagagtatccacaatgcacaggcaccacgcagcaaggtctgtgaagtttctggcatcaactttcacagtgtatctcaagtcccactcctccatgaagtcccccttcatcaccccgacatgaggtgacctcccccatctttgaatgccacttatgcctgcacccctctgtcagagatgaacacttatggcactggcatacattggtcttagttatcttccacctccaggcagcctccatgttccctctcagtctgagttagatacccctaataccaactcttataatgccctgtgcttccctctactaaagtctttaccaaacttctgccaccttctgtcaacttctctacatcctccagtaaactataaccttcttgagataaggatggatggtggcttacttagcatgtatatcagtccttaagttgggcctggaacgtattagttgctttaaaaatatatttgtgaaatgaatgaagaatattaactccccaccaagatatcaagctccttgagaacaggaatctggacttgtgcctccttgcatcccctaagtgatgcacacagtgggcttataataaatatttagtcagtgatttgtataaagaggaaaccatgttttacttcaataactttcactcgacacctaaggaacatgattttgtttgtatataccatataaaaacatccaatcattaaatatgtatttataaacatatacaacacgtagtcaagagtgtcaaatggaagcttggcctgacaattttctcccaccaaattgctcgatggtttgacttgaccctacaattggtcctgcatcacacagacatagcctctatgattttcttattagatcgttgcaagaaaaatcagcagtaattaaaaggagtcacttctgaagaagctattaaatgaaggagagcaagatgggggtggtcattaccacaggtaagagcaaggtgccttctgaggatagcgtaatactgatacatatatcctgtgacattactcgcaaaaagtctacagtctaccaggacactgctggtgattttctcaagaaagagagagccttgcaaagtgcaatccatcacttacagcaaaggctgatcactcagacatgatgatgctaactaacctaggtgtttaggatacttaaaaggatgacttgggtctccttttttccaggtgggaaacaatagccaagtgattctcccaaatccaaatacaaagtcacgttagggtaaggatgggatggagatggccatagtgctggtggggcaaaaggatgtggcagttaagctgggaaactagggcacatgttttcaaataaaggagaagggaagattctgagagggcatctgttaagttaagaaaatgaaaattcttgcgaggtggggaaaatacctcctgtagcagagagcagttttatacaaagtaaaagaaaatacctgtgggtcttctgacacaaaacttcaagttggactggaaaatatgtgaacacccaaagtatgaatattatcatattataatcttcaagcctagaagagacctaaagcaccctcaaaaaactgtgacagttttgccaaagtttgagtttctctcagaccccaaatattaaagcaacttttagtcccattcctctgaaatgtggagaagaggtatcagagggcattaagtaaaaaaatagaattatatgttcctggcatacacttgacagcagatttatacaaaactgattagtctttctactttgcccttacctccaccccaaaacatccaatcaaaagtgacttttgccagagatcacggagactgctgggcctctgtgaaggtgttattgatctcttaccagatgttatgggttgaattacattaaaaatttatatttataaatctatgtccccccaaaaatttctatattgaactccttacccccagtacctcagaatatgactttatttggaaatatgaccttatttggttcatcacagatgtaattcgttaagatgaggtcatactggagtagggtgggcccctaatccaatatgactggtgtcctcaaaaaaaagggtaaatttggacatagacaggcacacagggagaacctcatgtgaacatctaggcagagatcaggataatgaatctacaagccagggaaagccaaagctcgccaacaaaccacaagaagataagcaagtagcatggaacagattcttcctctcagtcctcagaaagaaccaaccctacccacaccttgatctcggacttccagcctccagtactgtgagatgatcaatttccttttttttttttttttttttttttaagccacctagtttttggtattttgttatggcagtcctaggaaactagcacaacagattaacaaccaagatcttcaatgtttgtattgccacgggctctcttccacagataattttaccaccgctgaagaattaccactgccctggtttccagagttatcttctttaagttaccttctcataacatcatgttggaaacttcaagtatgtataatcaaatttattttaacaaaagctgctttttgcttatagccccttcttatgtatgtacttctgttccatggttgggaaaatctgtgtttactaatttctaagatgagattgatacgaagccatctgttaaatgggaaatattcctgtatatatgagatagtcaacaaatatggttccaattaatgattttcaattagtatttaaatatttacttggactgtgcccatatgatgtcaaaataactgatttgcatgtgaatattccattcaaatagctgtttgtctacgtaacactaaataatgtggctgattgttgttctattaaaagactgactggattgaccagtggtttttggcatcataaagcatagcctagattccattatgaataccaggagaccaagccagagaaataaaaaggtttttcttttcttgaaactcccaaggactattaataatgaaatattacagtggaggggatgtttcacttaggaagtatcacttaataatattagttaatagtccttcctgtgggattttgtcactaccttatttcatctttattgttccatagggaagttcatttccgtggcttaggtgatactaactgctttatagagacgaaagtgttatctctccagatgaggcaaactaaacagtatgcctaccagactgataataaatagggaggcaaagaggtagggaaagggtcatgaacacgtttgttctcattttcctctttttcccactccctactttttctcatcatgcactgcccacagtgatggggactggatggatagatgtagggtgaaaccaaaagaagtaaattgggaagagtagtttgaactgcagaaagaggatgacatgaattggacaagcttccaagggggtccaaaccagacccatgattgtaactcagacattggccttctgcctacatcaaagccataacagtgggcgtgttatataaatctttgtggtcttctcacaactttctctgagtcttccacttcctttttgcctccacctcctttctttccccttctgactatgagtggtccctagaatccaactttactccttcattagagattctatagatgtgaggtgccacagcaagatgtggacatgtgaatctgaaattcaggatccctaaacaaatagcttctcatatctatctaagtaatacactggtctaatccaatacactttctagacaatctcactaattcttattaggatagtatggggattttcaagtaacattttaagatattttttaaatgatttttacaagaaagagaatttaaagatatatcaagaatgagattgcaaaggtttgtgaaattaacatctagtaataagtagagaaaaatttagaatatataatgatataacagcaaaaacatagctagtgggaatgtatgatggttcaggtacttttgaaaacagtttggcagtttcttaagatgttaagcatggagttatgaaatgacccagcaattccactcctaggtatatatccaaaagaaatgtggacttatgtccacataaaatgttattcacaaatgttcataccagcatcatttataataggactaaaaatacgtcattaaaatggtctcatatttatagtgccctggcaacggggcaatgaaagaatgagtgtctaatactataaaatgttggtcctattttcttcaatgtgattgctaactgtgtaaattaaagcaagcaagcttgtgtgtgtgtgtgtgtgtgtgtgtgtgtgtgtgtgtgtttcctaacagaagtataagatgccatcaggtaataataggggccttgtgtatggagtgcatggtgtttggtcaccttcagggatggattctagcaggtcatcagaatgaaaatccccaatccccagctctgcattataaagataaaaagaattgagatgaaccaaagacaggaggttttccagagactctcacccacgaaagccaatcatttcctccccctcctccttcttcttcttccagatttacctcctttccttcttcagatgaagttgtctcacgcaagcaactggtcctaaaatctaactcaattatttgagaaggaaggacatttattaacccacatgaatctctacactgtggatttcatctaatggatcgtagcctctaccttgtggactctccagaccattttccaggatgctggtccccattgtccagctctcattcccaaaatatcataatcaccctctatttgtcatagtctagagcttaacacagtccaccttttttccttcctcactctgataagaaattctgttcttcagtggaatttggtaaaaataaaaaataaactaatacttctggggttggatatggtttggcatggctatttggaatgacattatgtcatcagaaatcacgatgcagtatcttagctccattcttcaataatccaagtcctgccaattctatctccctaaaaacatatcaactcttccctttgtctccatcccactggcctctaccttgcttcaggccctaatcctttcttgtcatagctattatcatgacctcctaattggtctcttagcctctagtcttgttttcccttatccacctcctatgtggccaccagatttgtaaaacataaacaaacataaacccggccataaacactctttaaagccctgaaatggctccctgtcatctccagaataaaaacccagctctttatttgaacttataagttcctttttaacctagttcctgtatacttttccaaactattgcctatccatcctgagctattcatatttccgaaaacaagctaagccctttatcccatccttataatttcgaatgttattcccgctgcctggaatattctttctctccataggtgggttagctaactcttttacttaacagctttactgaaatatagtttacataccagcacatttattaggcttaactaactgctaacctttgagactccatttggatgtcatctcctgtgtttggttgggttccactaaagacagatcctgaaataaatatgtggaagcaagaggtttatttcagagaagattcccagaaagcagagtaacggaatggagaaaggagacagagaagagagaaaagtttataaagggtgtgttaatgagcatgagtgtgttattgctgtggacaatgagggctccactccattggaattcttggagagcctgtgagaaacacatctctgagttgtcccactgcaaggcaaagaagcctgggtatttatcctatccctcattaatttaaggtcatttctagaggtgttagctctctggcatttctagtgtgtctcatgggcaggaaacagctcagacagagagaggcaggaagacttcggtgtaaatggaaactacctagaatgaacttctgggggtggggggaggggataaggatggagcaccagatggcatctgtgcacatcttctttaaaacttttccaaccccgccgccccaccctgcccgactctgcttttcaggctaggttagaggaaccttctcactgatcgcatagcacgacaaagtccttgccacactacacaactttcttgtttcacttgttggccacactccactgcactgtggacaccttgaaggcaaggtctttacatctcttcatgctccgcatttagcaaagcgtcctggacctagaaggcccaataatgtatgtgtttgtttcaaagcattttacatttatcatcaacttttgcatctgaaaccctgcttaggagggagatagcataatcatcatcttcattattctcattttaaggatagaaatcttaactgcagtgatgtaacagagcagatgaaggaccttatctgttgatgactaggccagtacccaaactactttagttcctgttgcttagcacactgcaggaggtaatggcattcacctgaggctaaacctttcaacccatggcagaacagagctttccatgtccagaataatcccctttacaatattcagaagatgcctgaaggtggaagcagggcagccctagaaatgccaagttctgtgctttgtctaaaaaaggaagctttgattttttttttggtcttccctcacttagcctctccttggagctgcctcctgatttaacttttctacaattctaatatttgtgaatatgtaaatcagattttactattaattaattcaccaacataatgccatttatgagaaggaagtgatcagccacggggaacagaatgccttgtagctctgtcatttttaaaagtcaaagcaagaagtacacagttctaataacagaagggatgaagtgctttgttcttaggttatgctctggagtacgagttttaaaaggattaaatatataaacatcaaagaaagactgccccgaagctaagagttgtatcaggaaaccccctgctttcctatgtcccctatgttcaaacgtaagacaatggatctggtgattagaatggtctctgttcactttacacagtaaaggaagagaattaaagaagctttcccttagcaatatcacgactactggtgaacaactaaaaaatggaaacattttaacatgcataaggtcagagtctattcagttcctttttctgttatgtattttggaaccacttgacagttttccgttttaacattttgagggatttttcttggtagaattcagacaaggactgcagaagttttgccatctgcaaaaagagtgggttggattagattagcaaacactttgggttccatacaatatttttgttggtccacaaaactcctctgaagaataccaacattagaaatgaatccaaacactgaaaacccgattaatggataggccacaatattgccattttacagtaccattaaatgaatagcaaatacagaaataacattaaattgtttataatattcatggcatattatgttttctgattagaacgtttttaaatctagtcaaggcattttagaaatggaatcaagtaattttttgcttaacagcagaatgagtgaatggaaaaacatggattttgatatcagatagtcctgcactctatttatacttccattacggtgtaaccctgcacaagacatttaatctccttaatcctcaatttcctctctttaaaatgggtttgacaatgcttaatagcccacagagtgattttgcaaattatataggctagacacttgaaagtgcctagggctaaccttggcacatgaaatgcataaaaatattcttttcccattttctatcattcctgtaaattttcagcacgattactccttaactgcaagagattatattttagagtcatttctaacatttctctttaaatgtctccctcctcatacaaacatcacaagggtataaaagtaatggacacaatttgaaatatgatcatattggattagtggcccaccaatttaaatttattttcatcttaattggcctggcttagaaaaagatgatcaactcctgtattatattactttatagaacctctttagctctaaaatgtttctaaaaccaacttacaagtgatggaagttggaaagggtaggggtagctaggttatatcagatctgtccctggtgctgaaagtgagcaatgtacctaaactctcctcatatagatgcagtagaggggaaactagcgcgacttaatgaaaatcctgaattgtgccttgtttgctattaagaaagtgacattactcaggcatctccagaatacagtgctcatcctctttgaccaagttaaaactttaggaccaccccaagggaagaaagagaaagtagacaccagcccagcccactgatggatgcaggctgatgcatgctgaaacacaattacgtgcccatccacttgagttatagattagtctttaaatgcatatacactttgctgctttcaatgtcccaagcgcctctaagtgttccttgtaaaatgtgtctgaaccagtatcccattcagcacagtttagcaaaaagatactcatttatagttagcaacattcctttgcatattaaaatatgcacatccaatttaaagggtttctcttaaataagcactccccatccatcttatttacagctcgaatttctcatgtggactaacaaatatttgactatgtgaaatcagaattgtgaactactttttaaaaaataactgatcattggttctaacaaaatgattttaaaaataatttgtctgaatgtggcagcatccttatcttccttgagtgatttgtgtattttactctaataagccactaacatgcatttactcaagcctgctctgtgctcaatcctagcaccaaagttctgaaggtgaaatcaaaaggtaaggttcttggcctgtaggaaattaaaacattgctaagagaataggaaaaatatataatatatatagatatatatatgaaacatcagacaacaaagaagctcaaaacagcaagcaagatgctaactctagggctaaaggtattctaagaccagggaccagccagatatcatttatgatttctatgaatcccacacactgatggaacaggacttctctgaaatttaccttatataagttcatattttaatcctctgtattttcattcaaccatattagactacagatttcttgagagcagggaattctttgctcaatttctcctagttgccaagcacagtaggaacttgctcactgaaataattcaaataaaatcgctcagagttaatagagttaaattaatcaatgtttgttgtggcaatcagaggtttattggatgcgtgagctgggattttgagagaaccttgaaggaagggaggattttgaaaggtagagagaaggtatggccatgctttctgttaggagaaaaaagcaaagcaaaggtttagagctggccatctcaactcaccagtggcactgtgagcacagacatccagagagtgtgtgccaaagtgttttcccctaaatcagaacacgaaatacctctcttttggccctgagtcctgtgtttattcaggaagataattttgcatgacttttttccttacatcatcacggatcattcttctaaaagactcatgatgcttttgagagcctgctgagttggcagaacatcctggaagacccagacataacaattagcccacttttcagcagggatcatctacacacagcagtgtgtctctttatcttaagcaaacaattaaggcttgccacacgttttctcttttcgatttcaagtttaaactatctttagaaatctctttgggtaccatttcaaggagtacagtgttgctgtgtgtaaaacagcttcttggtcaaaacatggctgagacccagtagatacttgatggagacatccctactcaagggagctctgatgtttgccagaggagcttccctgctttgaaaggacaattcttgttatacttttaccttctctgcatgcgattccattctccaagaaatcttacgtagatcttttaggatagcagaaacacccaccacttggcaatatgtcagaactattgagattgggatggtataaaataataagcacactacactaagtgccaccttcaattgcagcctcccaaatatcctttgtattatatcacttgctatgcatagtgatttcatggttgacatagaactgtttagatttaagatatatgcatgaaaatattttgttgtttctcaggcagaaaatggtgatgtgattaaaagctaatgcttgaaacatttgctagacaagagcaggccttttttttttataaccttatcaaaccaaataatcttttctttggaatccctactccccattatgatcaatctctctggcatatctgagcaggactgagccaagaaactgattccaaatgtagcaaaggatagaaatccctgtaaagtaggactaagtcagtatttcatcaaagaatttaatccctgtgaaggaatgcccttgtcccttccaatttaaaaattattagaaaggcatttgttaggagctgtctacttaacatgtagtggcagatatttgatcctaagaaaatagagatacagccagagatttatgtacaggatgttcatctcagtgttacttatagtagtaaaatttctaaaaactaaatgaccaacaacttggcataagttaaattaaggttcagccgtatgatggaattctatgcagccataaaatcttttatagcaataataattgaaatgagaaactgttcatgggaaatatttcatgggaaaaaatggttatcaaacagaatttttactatgatcctcaattttagaaaataaagtaaacattgtatatacattgtcagtgtcctcttgccaaagaccaccaggaccacaccaagtagttggccaaactgggtttccttcgtgttgcagtgaggaacacacaccatggagaactaagaggtgtctcaagaagggggtgttagaaagcacttataggatttgggcttgtgttaagtaatttgggggaaggttgtgggttgtgtatatggggggcttacaccagattgggtgccattaggaagcaggggtagttttatgtctgagtgtcttaatcttttttctagagggagaaaagactagaatgaggctaaaggctaaagctgtaattttttttttttttttttttttgagacagaattttgctgttgttgcccaggctggagtgcggtggcgcaatctcggctcactgcaacatctgccttctggtttcaagcgattctcctgcctcagcctcgcgagtagctgggattataggcactggccaccatgcctggctaatttttgtatttttagtagaaacggggtttcaccatgttggccaggttgttctcgaactcctgacctcatgacccgcctgcctcagcctcccaaagtgctgggattacaggcatgagccaccgcgcccagccgtaattcgtttttaaaagaccacaactgtcctcatattagccaggataacatgcttcgtcattttttgtggtttggacagggttcatgttttgtctgttttcacatatgattatggagtggtcctaattttatcttaaaccatcacagttacagaatgctcttatctgacattagtgtttcagaaaatggtttatgttcggtgggagaacaccaaacttagttgtgagtgccaggctagcttctgaataccagggaatgcttttcttttcacacttatgtatagaataagattataacaaatatcatttattatatgtctgtgatatttcaggcactgttttaagtgtgttaatctatttaatcctcatagcaattctatggggttggtactattgttattcccatttttcagaagagaaaaattgtgccataaaaaagtaaagttacccactgcattttagctaataaatagtggagcaaggattcaactcagtggctacagaaccaaaagcctcaacttctacattatattgcctatgtgtacaataaatgatcgacaaaggttgaaaggtagtgtgagtacaccgatacaggtgtttttgtttccttctttttcttgttcttactttccaaattgtctaaaattaatatgtattaattttaaatcagaaaaggtaacaatttattaacgtactggtgaaagctctgatcacaaagtcattggcccaaatgcaaacccaagtcgttggtggaggcaatgctccccagaacttctacaaaaagagaagaaaaatcggggggaggcaacacccttcctgcactcttacgtgtgggctctctttctctctcgcccctctctctcgcccctctctctctcccctctctttcgcctctctcttccccctctctctcctctctctttcctctctcctcactctcactctctctgctgctccaattcaatttagacaacactaacgggattgcctgcagtaaaaggtggcccaaggtccacacttagttggttctgtctccaaattgaaacatacaggttagaagctcctccaaatatacataaggacagttaggaatagagttgggaggactagaaacaaatgccttggtcccaaaggaaaggccttttctgtgtgggaggacaacactctcgccctggccagctgagcaatgcagtttctcccgctctaagattcagcccaggcactgagggagggcactctgttcttcagcccttgtgagggctgacattaaaaggccggaaattctagggacgagggcgaaccgaggttggaagggagccaatcggagggtcaaagacttcagaatgaaaacagcttcgccaaaatgttaaaggcacctaagcagacctgtcggctggttttccttctcttacttttatccctgcgctggcatcggggcacatgaaacagctctgttcattccctgtgcagcgaccgattttaggcctcctgagaagtgcccacccactagctgccgctggctcagtcgcaaagagctgggttcgcagtatttcccaccgccacccctcctccccgcccttccatctttccgtctgcccgggctgagagccacgcagggcatccaccctgtcatttagcacctcggctacgcaatggtgggtggtttcccaaagcgcgtgccctcgcagccactcgcgctcgcctcgccgcttgcaggggcacaagtcaatgaggcttttccctccgcgatcatggtgaatcagcaaagcgctgcagagcagcggcacctccacgagcagaaattaagatgctgggggaacggcacgagtggagtgtggcaggggaatttctagccccttccaatgtgtccctcccagggacggcgatactgggggaggggagtcagctggaagctgctggacttaggcgtcgcggggagcctctggaaacagagcagtgtagggaataacgaagatgagcacagaaagtggacgagaaatgggtggaaggatctagggagcacaagcagagcagggcaggtgcgcccccggggtgggcagcgcagcaggagcaggtgttgctgaggaaaggtaggaaggaagtccggtatgggggaagggaggagatcatcaaataaggaggatttcccaaaccgcgacttgctgtttccaacgtgcaagttcccaagttcagtttgagaagtgaagggccgctaggtgtaggggagtctggaatgggaacgttagggaaatgcctccccgaggcgcattctcctacccattctcctctttcttcccccccccccactccccttcctcttcctgtccctattcgtcttccttcagctttgattaatatgcatgtctatgctccgtagtgcgggccaccgcctcccgttcgacccctggcactgggagactgagctgtagcgaccaaaggcttgggatggggaggctgagcgctcagagcgcggagtctgaggacccctcgccgcgccctgtatcccacccccctggctggagagagcgcctcagtgacccagactccgagatcccgctcggtctgcgttgcagtggacagacccaggagcttggagcgcgaaatgaaacgcgctaaattgtacctgtgcgtggccgttcccgccgccgccgcaggtctatcccggggccgaagccggcgcccgccttctcggggaattctccggagggggagtgcgaggggaaccacggtgactgcctgctagctcacggctggcgcgcacacgcacacgcccaactttgccaagccgtcggcgccccgcgggctcccccgcgccccctgcggctcaacacgctcggagacctgtatctctcctgctctgagataaggttccctccactctcacaccttcgcatgtaggggaggagagggcggagtgaggcagagaagggggttaatgctactgactccctggccagcctttctcaaacactctacgcccgcaggggcgcccgcgccagccacgccgcaccaggtcccccagacctgctggtgacgacagagagaggaggaggaagagaaggcagggcgaagaaccgggagccggggagccccggagctcgggagcccgggagcccaggcgacggacagttccatcgactgaccgtcattatcagcacttttattactaaaggactgggtgggaggttggggggtgtgcaacagagctggccagccccaatccactctggagcgaccctaaattagagccacagagaaagattctccacggataccttttgagtggacgtgctccagacacacacccggaccccgtggtcccgccgaagctgcagtgttgggggtattttaaacggttcttatttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtgagaggggacgggtgcgggcagactccgccagcgccgcggccgcggtcgggctggctctgcgctggggtcccggctgagagcgccacctctcctagcccaggcagctgccgcagggactctcctgcaccgcgcgccccagggcggccgactggagcctcccagcctcctggacaaggagcgtcggggtccgggtccggccctgcccgcgtcgcctctaccgccaccccgcagctgctgcaacagttggggcggcggcggccacagtgctgtggtcggtgcgcttgttttggtcgcagtgggcttgggggtggggaggctttggggtaactgggccagcaaggagcagaacgagagaagacattctggaaagtcctactacttgagaacaaaatactatgcttggaggggattccgagatacccctccctgtcctcagttttgtttctccctttttctggccccccggagtgtttggggaacggttgttggtgtgggatgttgggaaaggacaaaagaatgtgaggcgggatggtgatgaagatgcctcccacccacccagaaagaagtgtggtctctggcgaggacagggggctgccctgctgctctcttctccggagcgaggtagccatctctatcttctagggtatgaaattatgtttgtaattcgcagttccttcgtctttcacagtagctcctcaagaaatgccaaaactttgggaaaagagggaaccgatcaatccacttttatttgggtgcatctgagcatgggggtgaggggcagagcccgaagggtgagaacagaagccaggctgtgtgaccccgagaagagcacaggaaaccgagcagctggttagagggtgacactcgcagaaaccggttgtgccatcagcttgaggtgggaatttgatgtggaaagtgaggttaatggtggtaactttcaggaacttcctaagaaaagcagaggagtgaggactagagatggaaaagtggagacctcgggagagaaaagtaaaaataggtgagaatgttccatctgaatccctgatggggactgtggggcttgtttacttaaggttctcctttggggagggcagacaagaaccagtcccagctgggactctggtgcagagggatggaaggtgatcgttttgtgtgagtctctagtccagatctggtactagaggctggttagatttctagtctacttatcccaaggggagtctgccgggaaacctggggaactctttcctcttcttttcctctacaggtaatagtttatccctagagacaagctaattttcattattttcctatgtccgtttgttgacatgttatcaattagcaattagtaatgaggggaatctgactaggggctcaatggaattaggatcttcccacatggagtggctcatgatatttttaatggcacacatcacacatttactcatcacagaaccttaataacattaatcccgagatgtttgtttttctcatgattagacttccagcatcaaagtggttttcttttttctctcaatactttagtgactatattttgggacacagataaatactgctccaaaagctttcccacgaaaacacatagtagattcatcatgggcataaggaaactgtaatttaaccagttctgacagttggaaatgccccgtcttttgattgatgatctactaaatgatatttctctttttgtgttttttcaaggtgacgtttccattgcctttccccccccacccacaaaccatcacaccactgtgacaggcagtcaccagttacagtcactctcaaggttaatgagacatcaacaagcattatcagatctcttttcaactggattacttcttccctatttgattttgatcagttcaggacagaaaacagtgctataggagaaggttgagactggagagacggaggcttggtttgcctccatatctaaagggcaactttaaaggacaatggtcaaaaatcagtggattgttttaagaactgggatggtttttcatcttctaggtgtctgagtaaaatcaaaaccaagcctagcagtggtccgaacttatttctagctgatgactctctggtcaaatgagttcatacagcttataaaaatccagacttacggaaccaaggaaataactgtcttcaattttaaattatatgtttaattttttctttctgcatccagcccctacttttggtagatatggagccaggggacaggaagatggaccttcattagtcatggtaatgtaaagtgtgggagtgagcacttttttttttttaatttttttcatttagagacatgatgacttgtcctttaggaaaggtgtcaggagtgaaagaatcactgttattgttgttactagtgttattctgatgcttcgttactggcatcaaggatagcattgacagttaacactacacaacacccaacagtccctgccccctgccggttttatggcgtcacatttgaaatgaagtgaagtggacagagcatgagcaggtctgaggctttttcataccccagtacagaactgaggaggtgacttgtagggctgtgtagggtgttgcttcaagcatgaagagtagacccattctctcctcttaatgttttgggattgtacctgtgcagtgaaggagatccttcttgggatattggtcccactatttgctgacaaaaaaaaaatagactgggagggagtgatgacagaaaacgaaaagccaggttgacgtttttaaatgtaattgagagtattacagaaaaatatctgtatttcaaaaatccagctgatctggtttggaggagctttctcgaatatgcgcaagtgatatgattaccatactctgaccactgtagcttagaagttgaccccacactgtgaggcatgactccccccagcgttggtttcccctgaaggctacagggcaacgatgcattattaggcaaaagtgggtaggacctggtggtgctgataagggctcatgcagtaatttctgaacctctttacatacatgctgctcttcaaacatcttccttttcctagaaaattaaatttagctgattatatcttttaacagaagatccatgatgttcatctcaaagcaaatttcaaaggagggcctcacaagcttttatagatacgtttcgttgcgatcacctaaaatgaagtgtaagtaggtccctttgataattgatccaggctgttaacaaaacaattcttgatttattccggaatcatctatttaaagtgaagaatcagtacagcccagtacttatgataatgacatcatctttataggactttataggttagaaatatacagtatgtttaaatacagtaaattgggaaaaatgctatatcccattttacatatgagaaaactacttcttagaagttaactgacttgtccatgggaaaaaatacaaggctagaaccaggactggactggacccagggttttggactccaagcccagtgtgcttttcattgtaatttactttcatatgatacactactggaatgatttaaaatgtacatttttgttatccaaatgaagtacagttgaccaaagttttatatcccatcccatccagttgttctaatagtggtaattggatcataagaatatttttcttgactgattctgtctagtgtcaattaaaatccacatacagaaactccaaatacccaaagtaaagcataagatatttataattaacaatatacaaggatagaaagaagatttttttggaaaaaaaatctctggatgattgaatgtagctgcttcctgattgagtgctgctcattggcagggtccaggttgactgaactttagtgccttacacactccctggcacataatagctactcaataaatacttgttgaatagaccctccctagtttactcagacatttatgtgatgagttaaagaaaattccataaaaacgaatttgaaatgtatttacatagtgaaatttttatttttacaactttacagacagttactaggattctttgtttgcaagatatcattcttccctccttgataacccccgtagtcatatcaaagcgtatttcagtttcaaaattgggtaggggaattgcctttgtacaaagtcctcttcttcaggggaaactcagaatgttttattccaaaccacgggaaggacgcatcctcacatagcaaacattcttccatttactaggagatctcatttcgctcaaatatcaagtttctgttttacttaaagcttttatgtttaaatacattaaatagaattaagttgcaaacaaggttaataaaatctaaccttaagttatttacttcaggctttccaagaagggcagcataactgctagctcggggtcacaaagactgggtagctagatcaagatcatagtttttccaaatgctgtctcaacacttgcaatcactatgggaatcaccatcatttcttcctccacaatctaaggatcagcaaatttcagcctagtttttaacgtagactgagtttttacagttttaaaagattataaacacaacaaaacaaaaaccaagaaagctatatagcagaaattgtggctcgcgaagcccgagagatttgctatctgtacattcaaagttcctatgttgtattctaaaatgtcattactagagcactttcaagaagttaatactgtgaatctgtaaggcagtagttctcaaccggggctgactgtgcacccacccaggggacatctggcaatggctggagacatttttggttgtcacaacttggggaagaggcatgtgctactggcatctagtgggtagaggcacagcgtagcccccacaacaacaaaattacccagccccaaatgttaatagtgccaaggtggagaaactctctgctttgcatgtttcttttgttttataaagattctttttttgctactttgattatgtaaaatgaaaaaatgccaaagagaagttcatagaactctggggacaactattatgacctctgaggtgatgctctcttgggcagttgagcagagaccagattttccagtgtaatcgtccccaaaatgcagttatcttgctctcttcgatggctctgtcccttcaggtctaaatcccacctgctgtagaggagcccaagaaactgaatgcagtataactgcttgaatgacgaaggggctaagttgacactggcctttgagacttgtccattactagagtgcccattattggcatgccttaagcatcagtcagcagcagtcgcccacttaggtcgggcttcttctgacagtgtgtaagaccccactgtgagcagcgacctgaggaggcaggaggcagtgctttgttgcctattccagtctctctgcttttccaagtataaaatgacaagagaagagcttgtatcaaagaaacacggaatcaaagaaccttcggtttagaaggcaccttaaaggtcatctccacagaggctgatgctagaatcttctcttagcatctcagggtgctttgtttggtgacaggtgctatgaagccttgggcagtccagtctcttctggtgagttatccaagtggcagatactcttagaaaagattgagcctgggcctgaaagggcagcatttgtgtatttgctgggtcagtcaattgacttttactctttatttttgtactaggggaaaattaaggagagactgagatcggttttcattctcctttcatttcgtaggtagtgtatccgaataatctaagcacagtctcatcctagggttgtctgacttttaagtacatttgatttttgcgattagtatgtaaaatgcccacttgtctcatttagatttggggagcagtcttttaattctccatttaggtacacatttgagacaaactttgattaaactgaaatttagatataaagccttagtgggagaggaagcccacctttgtaatgactcatggcatcttgatagatgccatattagagttaggaaaggatgattctattttaaatgaccacaaaaactgagcctctcaggattcaccagacctataaagctcacaggacagtcaagcattgaactgatgactccttaaaaatacgagaaggagaagtaagctaacagaagttatttgttttctacctgagtgtttccagtcccttggcacaaaagccagggaaatgtgagatgctggtgagctgatcaactttgactttgtgggatgtgccatctggtacctgatttcggggctcagtgtgagccccaagtgatacttgagataggcttaaagcagacctttgaagtcacctgcttgatagcacatcacagcaagcaggcctgtctgcagcactgcctgtgtctccgccacatacccggaaggccacagaactaccgaggaatcctgccagactgatttaatgaccagcaggggaggtgagtaatcgctaacctttaaaagacaagaaaaggaaaaaaagaaaatcaacaccagttgttatttcttacgggaagccctgaataatatgttgtgcttgcaacttctgaattcatattttgaacaaaaggaggcagtgaggaactagaaaaagctatttttatcttcttgctctctaagaaatcctcttgagaatattgtttctgctattttgaaagatccccattgttaggtcttccactttaggtttaattcataggcttcaagtacagttaagatgatttatgtaagtgcagtcggttatcttgggaggtgatatcagaaaaggctgataggggagtggggaagtaaaacagtgagtagcaggaagccaatcaagagagtattattaagcaagtgtctactgtgggcaactggggctcagtctcactagggaactctgggagacactgtagaatgtgttggagaaatctcagttgtggataaagaagctgaatattttctccccaactccagccatcatcggctgattcaactacatttagaagcattaaatttctggcattttcatatgctgtgtttctccctatatatatatatatatatatatatatatatatatatatatatattttttttttttttttttttttaaaagaattgggtacagagctacaggtgtttgtggcaagcaaccttagcatggagaggtgagtgtgagctgagactatatgggtgggaccctgagagcatctgccctaagggtcttatattcatctagagttatacatcgagagatttagtgccccgtttctagggaatggatattcatccctttactcaacaagatggctatgaccctgtctccatgaagcttacagttaagaatcatccagcatagctatttagttattcccaagtttgacaagtgccagtggatgctggtaaagatgactccaaacagggcctagacaccaacaggatgtgtggttttagatgccagacctctacatttgagaggcacatattcattctcacctttatgaatacagaagtctgcaggcccccatcttcacacatctacttttgttgttctccctaaaagtgccctccctcctctctttaaggaccagttcacatgccttctactttatgaggctttctcagattcatggcttcttctctcccttaaatctattgggctttcattcttatacacattctttaatgcagagctgtagactcttatgtaatttgctatattgtcatgtgatcgtttctcttaagagaggtaatgaactcttcaggggcaggaacaatgtctgacactgccagatctctcctagagcctagcataatgtggagtttgcagcaggtgcttaataaattgttactggtttatagcttgtaagatggaaaatgtgctctgcctccctattgatttattttggtcaaatataattttgcctggtagcatgaccatgtgatttcttgtgctctatattcatttttcatctttgacaaatcttggtttcaaacttgttgataagcaataagcatccattctgtttccagatctgctgccatttatatgaggagaaattcttggaaaaccaaatatctgacaaccttctctggtccaagtacagtttgggagggtatgaacttgacctcagtccccaatcagtggtgcatttccatgtgggagggtggatccctgtgcagttcccagtgagcaccctggaacccaagtccccacactacacattcccttatttacttaaagaaaagtctcaaaacattggccacacccatattcaaatgtaaataggaaacacacttaaaagaaaacatcaaggacaagtggttttcctgaccatagcaccagtgttcaggagatcaccattctgatgttgcttagtcccactcttcttaaaagttagcccagaggaacagaaagtattgttctaagaggcaaacttaaaagaaaatgatactggtacaaaatcagcatatttctgtgagtttaatggaaacactaaaactgctaatttttcagcgtggaagataaagattcctttacccattcctccatgaggctctcctgctgtcactaataccatggctttgtcaattctttctaattgtctcaagaaaaaataatgcatctctgctatagagctgtcattataaatgctcaagaacattttgtgatatttataccttaattgtatgaggtttgagttgttggattttgtttttggtcttgtggtataggcaagtagtcctactgagtaaagattgtttgattgctctcagactttctaacatgcacacacgtcacctaggcatcttgctaaaatacagactgattcaaagggtctggggtgggaactgcaagtctgcatttctaacaagatctgaggtgatgctgatgctacagatcagcagaacacacttggagtagcaaggctcaaatttaactgttgtaaacagaaaactggatttagaatcaggaaagccaagttcaagttccagttctcctaagtatgtatctttgggcaagtcacctaacctccctgagaaacacgctccttatttgcactgggtgtaatagcatctctttcacccacttaaggtaaagatagaatgagataaagtatgtgaaggcactgtgtaaccatagccttctgtaaagtgtgttatcattattactatttactttgaaaatgactgctatttcctcacatgtgccagctctttcaaagccattattgcctgttgagtaatacacatgtagccacttttttctttgatccaacaggcaataatgggtgctcaagctacattcaatactcatattgccaatttgttggtctttaatgactccatctgagtcattacagacaattggattcaacctactgctgagcatgcagctcctctacctgcagaaagttcttaggcaggcagagctgcggatggggatgggtgcattgcattccagcacaccaacgtggttcctctgggctcagaacctactcttcatgcctgatggggctttgcacacaaaaaaagccttcacttcctgcccagggaagtgccttttgaattaaaggttctgagaggctgcgggctctggtttcagggctctcctcaccacatctcacagcacagcatgccaaagagggattctccagtgatttaggtgagaacgttgatcattctcctctcttactgaatttacatgactacagtgtttccctgggaaatctcgtccacataagtagatctgcaagcacttcacagggaagagtgtcatcagaattgccagagatcaggagcaccaggcaaagtgataattgtaaagtcctttgaaactggaatgttgcgaaattttgcagactgtgaattttgatcatttagttcagtgtgcttccccacctacccctttagaaaattgctttttataggatcccaaaagaaatccacaattattcaggctccacatcaaatccaccaaagaagattcctctgcctagctggttctctatccctaatctcttcaaacaaaattaacctctgtgtaagtgagggttagcagtacttctcaaactttgtacttctgaattccctgggaatttcagcatgcagattctgattcagtaggtctgaggcagtagccctgacattctgcacttccagcaagcccccagggatattgatgctactggtctgcagaccacattttgagtagagcagtagattagtggatctaaggaaccttgctgaacctttgtatatcctgactactcagttctatttaattgcctctgtaagctaaagtagtggctctccaacttgagcagataggcattggagaacttgttcgaaacagattgtggtctccaccccagagagtttctgagtcagtaggtctggggtggagcctgagaatttgcatttctgacaggttcgcaaggtgatgctgttcttgctggtctagggaccacactttcagagccactgctataaagtatcctagaaattagctaccaggactacttccaaaaatgcagtctctctctgtggaatctggccaataagatacaagcaggatgaaaaagttgtttgctcagcacttaattctgaatgatgctataatagctcttctacaaagggtattaaataaatctgaatatctgaagtttgcactgtaaggcaagcatgttgaacagagggccgtactctactgcctgtctcctggtgttggaattcaggagaaaagggctgagtagaagaaaggacaccctgagatggaggaagagagatacacctcccccacaatacacacacaccatggatgtcgttgctaccatcacatatgggattgccaaagctttcgttcttccaaagccttcccatacagggtcatctgccatttgccttttccagaacttcctttaaagcaaatcagatggtacagcaggcacaaataggagctacatgctgcatttctgagacagggtcccagtactgtggttctgttaaagaacaagttactcaaaacccttgttaaagaatggtaaggcagagtttattcagcaggagccactgagatggtatagggactactgcagtggggttttgcagtaggggagagatccgacccactcggaatatgacagggaagagtgggaatttatagccaaggagcaggatggggtcagtggatacaacattattaagaggaaacatcagggggaaggggcagattctagctaaaccaatccgacaggattcttgctgaaagctggccaggatgatcagatatcatctgagagatggtcagagatgaataatttagtcagatatctagaatgatcagatacaaagggtgggggattatggttaaatggatttagaagaagtcttcctaaaattggatgatgtaaagacagaaaaggaaatctgaatgccaagggttagttggtgagaaggttcagaggagcctgactagagtttggtaaaggagagtcgtcagttgtcagaggtgaggtgtccacagggaggaccctggcaactaatgttcagtgtcaattactgtttgatgtcaagtgctgtcagagagaggtgacagttgcaaccaaaattcagtgggtaccagtttaggcagagtggaaaaagcattgctttagaacccaaagttttgtgtttgaggctgtgaactattaatgtgtccttgatcaagtcagtcacttaacctctctgggaggtctcaatttcttcatctataaaatgggatcaacaatattatcattgtgaaatccacccagtgttctctattaacaaatgcttactctccaggagaatggacttgccagagcacgattctgaaactttatcctaggttctttcccatttcagcccccttcagcctttctgccttacctaagagttggtggggggagagtcaacaggggtcagggattcaaagaaatcaatttgaagcactacagccagggaagggaatagaagacaggaaaaaactataccactagagaaatacttgtgaaggtcacaggtctactaaaagactgagatttcattggaagattatatagcaatttccccttaccacactttactaccacatcagcagagctccagtttaataatagtggattacagctgaaagagcaaaaagacacagaccctctctgaggagaagtatgtgggaaaatccaacgtcaacaagagagacaaaaacaaggacagtagaggaaattaaagcttctggtacctatagctacaacaaacattaaatacattctgacccctagattaacataaatcttccctgtaaagtcctgttatcttagttcctattaactgatataacatgtctagccttgaagaaaaaattacaaggcaagccaaaataaaatatatatagtctgaagagacaaaggaaacatcaaaatcagactcggatatgggaatttaaattcaataccagacagggaattgaaagtaactatgaaggccaggcgaggtggctcatgcctataatcctggcactctgggaagccgaggtggaaggatagcttgaggccaggagttcataaccaccctgggcaacatagcaagaccccgtctctacaaaaaaatttaaaaaatattaacagggcatggtggtacatgcctgtagtcctagattcttgggaagctgagacaggagggtcatttgaccccaggagtttgaggctgcagtgagctttgatcacaccactacattccagcctgggtaacagagtgagatcctgtctcaaaaaaaataaagtaacaatgattaatatgttaagggctttagtggaaaaagtagacatcaagaccacatgggtaatgtaagcagagaagtggaaacttaggatgaatcaaaaggaaatgctagagataaacactggaacagaaatgaagaaaggctttgatgaactcatcagtagacttaactgccaaggaaagaatcagtgagcttgaatatagggcaatataaacatcacaaactgaaacacaaagagttaaaagagaaaaaaaaaaaaacccaaacggaacatctaaaaattgtgagacagggttatcaaaatatatgacatacacataattggaataccagaaggagaagaatgaagcagaagacgtttgaagtaacaatggccaaaaactttctaaaattaaagacaccaaaccacagatccaggtagctcaaagaacaccaagacagataagtactcataaaaccacacttaggtgtatcataatcaaactacagaaaaccaaagacaaagaggaaatcttgaaagaagccagggtcggggggacaccttatatatagaggaacaaggaaaagaattacattagagttgtcagagaaaaaactgcaagaagagaatgaagataaatagttaaagggttaaaatgaaaaaaaaatcaacctaaaatgcaatagccagcaaaattatgcttcaaagtgaaggagatataaagactttctcagacagaaactgaatgagttcatcgccagcagtgttgtcccgcaaaaagtgttataagaagttgtttaagaaaaaggaaaattatataggtcagaaactcagatctatataaagaagagtattagagaaggaataaatgaagctgaactaaaatatttttatttttcttactcttaattgatctgagacataacttcatttaaatcaataatagtaacaatatattggatgattataacatggataagtgaaatgaatggcagccatgtcacaaggcatgtgagggaggaattgtgaataccctgttataactgcaccacatataaagcagtattgtttaaaggtgaacttaaattaggtataaatgtgtattgtaagtgctagggaaaccactaaaaatttttttaaagaagtaaaattgatacactaacagaggagataaaatgctcaattaaaaccagagaaggcagaaaaagaggaggtaaaaaaaacaggaacaaatgcaaaaacaacaacaacaacaaaaacaaaaaacagaacagttaccaccatggtagatattaatctaattatatcaataatcactttaagtgtgaatggtataaatatacaaagtaaaagatgatgactgtcaaagtggattatggaaacaaaaaagacctaactctatattgtctataagaaacccactttaaatataaagagtcatacagttaaaagtaaagggatggggaaagatatgccctgctaattctgctaaccaagagaaagctagagtagctatgttcatttcagacgaagctaacatcaaaacaggaacaattatcaggaataaagaggtgtattacctaattataaagggatcaattctccaagaagatacaacaatcctaaatatgtatgtacttaacaacagagcatcaaaatacataaggcaagaactgatagaactgaaaggagaaatagacaaatccactattatagttggagacttcaacattcctctgtcagtaatggattaaacaaaaacaggcagaaaataattaaggatatagataatcaggacagagtaagggacagcatgtctactactctgggaaaatacataatccgactctaataagggtacctcttacagaagtgtaggggttaaataggagaagcaaaacactggagatagggagatgccttctgtgcacccaaggagctgttaaagtctgcaggcagaaggcttggaatacaatagctgcagaaagagaagaaaggacatagatcagaccaccattttccaaaatgtgttctaggaaagctccctttagtgctgttaaaaaaaaaaaaaaaaaaaaaaaaaaaaagacctgtgtggccaaataactttggcaaacaatagatgtggtaccaccatctcagatcctcatactgcatgcacgttatcatagtaaaagctctaaaaagttcctctgtaaagaaacctatttaactctgtccagtttggcatttctcaaatctatttgagatgaatattttttacttttttggtggcccctatcaacatcccaagaatctaatgtgcctcagaacatacactgaaaatgccagcccaaagattgggagatagaattaataagacttcaagataattggatctgggagtcatcaaagggaaaagggtgacgttggcttagaagtttcccagctgggtgagtagaaagaggatgatgctgtgttaaccattacaggaaacaggtggaagaacaaatttggagaaaaggattcagctgttgtatatatgccagttgcaatactcccaaaccatttatttgcaaatcttcaggaggcagatggaaattaagatccggagtttgaagaagaggtaaagtgtgaatgtgaactggagattggtcagtgtaaaggtcacaagtcaaaccatggaggtggaattcattgcccgtgaagaatatattctgttatgacaagatcagaagtgccaaagacagtcttgagtaacatcaaatttacaaaataggcaaaggtagagaagtcagaagaacactgagaaaagctaggtcgaaagataggaggagaggaaagagttgagtcatgtaattcattatgggagaaagaaagggtttcagtcaaactacaaatatttactgagtaactttgtttgccaggcatatagtagaggatgcagcagtgaagaaaccatgctcaggccttaccagagcctactggattcccatgaaaatggaatccatattttcatgggaatccagtaggctctgtctacttttcctatcctgattcaaatgggatgccagtatgacaactcctatgatttgtcatgaatgggaaaccaagtgccatcttcaaaatttcaggtcttaaatctggaggaggaagccaacatccttttggagccatgaatactgtccaaactccatctgttgctcagattggaatttcggtggaatcactggacagtatggctcagcagactcctgtaggtaatgctgctctatcctcagttgactcattcactctgttcacacaaaagatgttggacaacttacacaattttgcttcatcatttgctgtctctcaggcccagatgacaccaagcctatatgaaatgttcattctgcaaaatatgtttctgaaatggtacgaaaactttcaaagatgactagcacagaaccctctcttttggaaaacataatttgaataaaatagtttttaatggattctgaaatttgtcatgttttgaagataactgactccatttaaaagtatgaagtcaaagaatcatgaaacctaggtttaaaaacttcttagtgactgaagcttaattaaaatctttattaaaaattaaaaacattgaaaatggaaaaaaaatgctaaaccatctcaggatatttttaggtactcccttgactttttattgttgacttaactgggtgccgctgctcagagttgaaggaaatgaagatttaaaaagtagccattgaatttatcttcttagaactcattgttgagttttggttcagcgctaggatagaatctagactgtagtggtttgagaagtgagtgggaggtgaggaaataaagttagcaagcacaaatcactctttgaggtatagttggagacatcaaatgcaaagggtttattaaagaaggggagatgtggcagaaggtggaaaggacatggggttaatgaagccttttttaaaatatggaagagacatgaaaatattttaaaacccatgggaaagaattagtagagtttgaggacgtgggagaagaaggaatgaactgtactagaaagaaggaaaggaaagataaaacccagtgaaagcaattgaccttaaaaagagagagagccatgggccttgattttcacaggagggcgagaaggggagtaggtttaggtatttatatggtggcagcaagttggtaattcccatctggctggggtttgctctggaagatagaaaacaaggtcagcagctgaaaatgagtcttgtcaagtgctaaagaaagaacattctaatatctgtgagcttggtgaccaactgacaagggaatgagaagaggctaggtcctaatgtggaagcaatctcttttacagaatttgagtatgaaagcaaagggacagtctctccttcccttttatctcaagatgagcaaaagtatagagaagaaatttaagtggaagtttgttgagagagttcacatagggtatatttaaatttcagaagaagaatatggattataaagtaagaaagaattattaactccgagaattatttggcatttgaatagctcatcagaggggactggaatgacctagaatggcttaaatagaggttgggatggtgtgacctccgaggatcacatagcctttaaatttcatcacatatctcagtggttctcaaccctggctacatattagaatcaccgtagtaactcaaatatactgtacccaagccttaaacccatggattctcatttcaatggtctaaaaacagtggcctactccaaatacagtccacagattggcagcgtcagtagcactggcaatcgcctgggaccctattagaactgcagactctcaggcttcacccagacctagtaaatcagaatctgcattttaacaagatccttagctgatttctacacatcttaaaagtctgggaagcgctagactaaagcatggtctaaagtggggcccaaacttaggtacttatttgaagctcccctaggaaactctaatgcacggttagagttaggaactgctgctagatagaaaaagagatcattttacaactgtattaagcgcatgtgataaaatctcattgtattctatatacacacaaaaaagaatgcatgtaaaaactggtgaaatccaaataaggcctgtcacactgaccaaagtcagttttgtggttttgctaatttactatggtaatgaaacatattaggggaagctgagtaagggatacatgggaactctaaactaatttgcgacttctcatgagtcttaaaggtttttttgaaaaaatttaagctaggccgggcacagtggctcatgcctgtaatcccagcgctttgggcggccgagacaggcgtatcacctgaggttgggagttcgagaccagcctgaccaacatggagaaaccccgtctctactaaagaaaatgcaaaattagccgggtgtggtggtgcatgcctataatcccagctacgcgggaggctgaggcaggagaatcgcttgaactcaggaggcggaggttgcggtgagcggagatcgcgccactgcactccagcctgggcaacaacagcaaaactctgtctcaaaacaaaacaaaacaaaacaaaaaaaaaaaacgtaagctaagagatcctacctaagatgaagagcagctgctttccatcatcatctgagatgaacacgggctccatcatttattcgtagcggagccattcaaggatttaaagcagaggaaagacagatttggatttgtgttttagaaaaataagtctggtggcatatgaagggtagatggaaagcaaaaaaagctaagttaggaagctgtttctgccatccacatagattataagggctagaaaccaaatcaggagcaatggaaatggagtagcagaggatggatttgagagatttgggaggcaaaatcaacaagattttatgaatgatggaagggttctcaatcttgactgtgtgttatagtcttctgggacgctttttaaaatacagatatctaaaccctcaccaagagattctgatttaatggtatgagggtgggcccaggtatctgagtttgtaaagttcctcaggtggttcaaatggtcagggcttacaggggctagatcagagattcaggccgaggaagcgggaagtacagagcaagcctcataggtttttaatcaagtattccaggaaccagcatggatgaggaggaggtagcaaagatacagcctggaaaaattagagcggtagcccttccttttccatttgttttatgttgagaaaaatcacaaaactttgagttaacgtgtgtaaagccataatccttgcaccttatctatcttcccatggcctgtctagacaaacagattaaaaaaaaaaaagttcagttgtttgtgccatctaaacataacctcagcttattttacacagagagagagagagagagagagaaacacacaactttcttgtcaatcccaaaatttgaagtacacaaatatatatatatatatatatatataaagaaatcctccagaagctaggctagaatggcttgggaacaaggtgaaattctttttttttttttttttgagacggagtctcgctctgtctcccaggctggagtgcagtggcgccatctcagctcactgcaacctccgcctcccaggttcaaactattctcctgcctcagcctcccgagtagctgcgactacaggcgcctgccaccacgcccagctgatttttgtatttttagtagagatggggtttcaccatcttggccaggatggtctcgatctcttgacctcgtgatcaccccgcctcggcctcccaaagtgctgggattataggggtgagccaccacacccggccaaaattcttatttttttttaactgctgctagccattctgtgtatttcggaaagcccctcccaagttgtctcctaaagtccacccagacattgttcccatctttctccagagaaatcgttcattttgtgtaggtttgcttttattcatgtaaggcttttttggggggaggggggagggagaagccagccaattgctgcgacaggtatggagtgtggttgctcctactccccgcctactggggcagcagggcagcaggcacagcaaagcttcctcagcactcagtgctaatagaccccgagattccacggaaggtgtcctgtgagtgcgcaccctaccctcagattcacacgttgaaagcagccaatgactgacagactgtcttttacagggtgatctgccaaagccaccagtctctgcctgataaaaacaatcagaggtttccctactgagagttgcttgccgcctattggggtctctctttataaaattgtgtgcaaagcaccatgaaaatgtttccacctcaaaatggtctgctctttggcatttcacttttcccttttaggacatttttgctccttttcaactgaaaaaagttacaaagctctcatagccattataataatgcataagcacctcataatataagcacatcacagattttaacaattattttaagtggttagtgtgagatagaaaacattaaggtggcatgtcagggctactgctatgttccaggttcttctattacattatgtctcagctttctatgagctatgttatttacaaggtaaaagaataacacctaagttcatccattgcttaagtgaacccaaacgtagtttgagatctgtaggccggtttaaattgagtctggtaaagctacttcagcctggaaaaggagagaagaaatgatagactgagaatttttaaatatttaaatattctcattccaatgtgctagccattttacaaatgcatatattaatatctgcctgtgtattcccttgagagctgggctggaaaagcgttgctatactttctggtttggttttgtttttaaactgccacagtatctttacttttacaaacataaaagtatatatacttattttaacaatgatcctttcccacatgttctgtttcctcttgtttgtttgcttttttgtttgcttgttttgctttttttctcgagtcagaattagctagtacttttgcttaatcacttctcagtatttaacaaggtttcaggacatgcaaggggaagctgtttaatgcacgctggtgatgccaaggagattgtacaagagtatgttggcttgtccagaatgtttctatcttgagtattgcgtgcctactctccacatgcactgtgctgggagcggggatataacaaataacaagattgagttcctttcttcaaagagctgaaagaagatgccattataatatttcaagtgataaaacagatgtgtaaacaccctggggaccagggaggatctaaaatgcgtgtctagagcaggcttcctggaggaggttacgcctaagctaagcccatcacttctcacaagtccaaactcctgcaagggagggcaggggactacaacttggctgctcactctgcagccctttcagaaacagccccagtttcttattagtgctgattcgcaccagctttttccccagaatagaggacagggctctaaagagtgcccggtaaatcccttccagcctcaaatcaaataagtcactgcagaatatcacatccagtaaaccttgccattgtacctccaacaaaaagagaagggctgcttctcaaaaagaataccaccctcacagcatgagagaggcagttgctctatgacaacgccactagacagcaaggacaaatatgggatttccaggcattaaattaaaaccatcacgcacttcacaaatagcaacttttgggtgaaggtgccagctacattttctgattgagatggggaaatgattctcaatgcacacaggagctgaagagtgctgaacacctgtgataggcttttctgccaggcatttcatctatgttgtctcattcgggagccaacaacactacaagatagtaatcccattttgatgctggggaagctaatgctccagaagggtgacttcctcaaggtcatcaggaagtgactaacttagtttgatatgaatacaagtctgtatgactgaagtgtcagactctttctaccataccaggctgcctctggggctcttctttcttgcagtgtttacagtttagcttactggtcttgaagttagatattctcccacagaacagtaaggaaaagacaaaacagcctaatatccaaggggcaaaaggcttgatcagatactttggaaaagaagatagccacagggctaatgagcatgtggaaaggtgcctagtttcagacatcatggaaatgtgaattaaaatcaaaatgagataccagtacacacccatcagaatggtaaaaaattaaaaagaccggcagtactgagtgttgctgaggatatggggtaactggaactcttatacattgctggtgagactgtaaaatgttatgatcactttgggaaacaaactaaatatatgcctactctgtgatcccaaaattccacccatgagtctatatacccagtgatgtgctggggctggctcctactgactcctgaaatctgactggccacatcttttccaaactcccactccattggtagaagaaaaatggccatggtggggtatttaccaacacaaaccacagcttttttattattattattgttatactgtaagttctagggtacatatgcacaacgtgcaggctagttacataggtatacacgtgacatgctgacttcacaacacccatcaacccgtcatttacattaggtatttctcccagtgccatccctcccctagcctcccaccccacgacaggccctggtgtgtgatgttcccaccctgtgtccaagtgttctcattatttaattcccacctatgagtgagaacatgcactgtttggttttctctccttgtgatagtttgctgagagtaatggtttccagcttcatccatgtccctacaaaggacatgaactcatcttttttgtggctccatagtattccatggtgtatatgtgccacattttcttaatccagtctatcattgatggacatttgggttggttccaagtctttgctgttgtgaatagtgccgcaataaacatacgggtgcatgtgtctttatagtagcatgatttataatcctttgggtatatacccaggaatgagatcgctggatcaaaaggtatttctacctctagatccctgaggaatcaccacactgacttccacaatgattgaactagtttacactcccaccaacagtgtaaaagtgttcctatttctccacatcctctccagcacctgttgttttctgactttttaatgattgccattctaactggtgtgagatggtatctcattgtggttttgatttgcatttgtctgatgaccagtgatgatgagcatttttccatgtgtctgttggcttcttttgagaggtgtctgttcaaatactttgcccactttttgatggggttgtttgtttttttcttgtaaatttgtttgagttcattgtagattctggatattagccctttgtcagatgggtaaattgcaaaaattttctcccattctataggttgcctgttcattctgatggtagtttcttttgctgtgcagaagctctttagtttaattagaccccatttgtctatgttggcttttgttgccattgcttttggtgtttaagtcatgaagtccttgcccatgcctatgtcctgcatggtattacctaagttttcttcaagggtttttatggttttaggtctaacatttaagtctttaatccaacttgaattaatttttgtataaggtgtaaggaagggatccagtttcagctttctacatatgactagccagttttccccgcaccatttataaaatagggaatccttcccacatttcttgttcttgtccggcttgtcaaagatcagatggttgtagatgcgtggtgttatttctgaggcatctgttctgttccattggtccatatctctgttttggtaccagtaccatgctgttttggctactgtagccttgtaatatagtttgaagtcagttagcgtgatgcctccagctttgttcttttggcttaggattgacttggcaatgcaggctcctttttggttccatatgaactttaaagtagttttttccaattctgtgaagaaagtcattggtagcttgatggggatggcattgaatctataaattaccttgggcagtatggccattttcacaatattgattcttcctatccatgaggatgaaatgttcttccatttgtttgtgtcctcttttatttcattgagcagtggtttgtagttctccttgaggaggtccttcacatcccttgtaagttggattcctaggtgttttattctctttgtagcgattgtgaatgggagttcactcatgatttggctctctctttgtctgttattagtgtatgggaatgcttgtgatttttgtacattgattttgtatcctgagactttgctgaagttgcttatcagcttaaggagattttgggctgagacgatgggattttataaatatacaaccatgtcatctgcaagcagggacaatttgactttctcttttcctaattgaataccctttatttctttctcttgcctgattgccctggccagaacttccaacactatgttgaataggagtggtgagagagggcatccctgtcttgtgccagttttcaaagggaatacttctagtttttgcccattcagtatgatattggctgtgggtttatcataaatagctcttattattttgaggtactttccatcaatacctactttattgagagtttttagcaagaagggctgttgacttttgttgaaggccttttctgcatctattgagataatcatgtgatttttgtcgatggttctgtttatgtgatggattacgtttattgatttgcatatgttgaaccagccttgcatctcagggatgaagccaacttgattgtggtggataacctttttgatgtgctgctagattcagtttactagtattttattgaggatttttgcatcgatgttcatcagggatatttacctaaattctctttttttgttgtgtctctgccaggatttggtatcaggatgatgctggcctcataaaatgagttagggaggattccctctttttcattgactggaatagtttcagaaggaatggtaccagctcttctatatacctctagtagaagttggctgtgaacccctctgttcctggacttttttttgcttggtaggctattaattattgcctcagtttcagagcctgttgttggtctattcagggattcaacttcttcctggtttagtcttgggaggttgtatgtgtccaagaatttatccatttcttctagattttctagtttatttgtgtagagatgtttatagtattctctgatggtagtttgtatttttgtgggatcggtggtgatatcccctttatcattttttaatgtgtctatttgattcttccctcttttcttctttattagtgttgctagtggtctatctattttgttgatcttttcaaaaaaccagctcctggattcactgattttttgaagggttttttgtgtctctatctccctcagttctgctctgatcttagttatttcttgccttctgctagcttttgaatgtctttgctcttgctactccagttcttttaattgtgatgttagggtgtcaactttacatctttcctgctttctcttgtgggcatttagtgctataaattgccctctacaccctactttaaatgtgtcccagacattctggtttgttgtgtctttgttctcattggtttcaaagaacatctttatttctgccttcatttcgttatttacccagtagtcgttcaagagcaagttgttcagtttccctgtagttgcgtggttttgagtgagtttcttaatcctgagttttaatttgattgcactgtggtctgagagacagttggttgtgatttctgttcttttacatttgctgaggagtgctttacttccaactatgtggtcagttttggaataaatgtggtgtggtgctgagaagaatgtatattctgttgatttggggtggagagttctgtaggtgtctgttaggtctgcttggtgcagagctgagttcaattcctggatttccatgttaaccttctttctcattgatctgtctaatattgacagtggggtgttaaagtctcccattattactgtgtgggagtctaagtctctttgtaggtctctaagcacttgccttatgaatctgcgtgctcctgtattgggtgcatatatatttaggatagttagttcttcttgttgaattgatccttttactattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtctcctgaatacagcacactgatgcgccttgagtctttatccgatttgccagtctgtgtcttttaattggggcatttagcccatttacatttaaggttaatattgttatgtgtgaatttgatcctgtcattatgatgttagctggttattttgcccattagttgatgcattttcttcctagcattgatggtctttacaatttggcatgtttttgcagtggctggtaccgtttgttcctttccatgtttagtgcttccttcaggagctcttgtaaggcaggcctgggggtaacaaaatctctcggcatttgtttgtctgtaaaggattttatttctccttcacttatgaagcttagtttggctggagatgaaattctgggttggaaattctcttgtttcagaatgttgaatattggcccccactctcttctggcttgtagagtttctgcggagagatccgctgatagtctgataggcttccctttgtgggtaacccgacctttctctctggctgcccttaacattttttccttcatttcaaccttggagaatctgacaattatgtgtcttggggttgctcttcttgaggagtatctttgtggtgttctctgtatttcctgagtttgaatgttgtcctgcctttctaggttagggaagttctcctggataatatcctgaagagtgttttccaacttggttccattctccccgtcactttcaggtacaccaatcaaacgtagatttggtcttttcacagtcccatatttcttgaaggctttgttcgtttctttttactcttttttctctaaacatctcttcttgctttatttcattaatttgatcttcaatcactgataccctttcttccatttgatcaaattggctattgaagcttggacatggttttcagctccatcaggtcatttaaggtcttctctacactgtttattctagttaaccattcatctaatcttttttcaatgtttttagcttccttgcaatgggttcgaacatcctcctttagctcggagaagtttgtaattaccgaccttctgaagtctacgtctgtcagcttgtcaaagttgttctccgtccagctttgttccgttgcgggtgaggagctgtgatcctttggaggagaagaggcactctggtttttagaattttcagcttttctgctctggtttctccccatctttgtggttttatctacctttggtctttgatgttggtgacctacagatggggttttggtgtggatatcctttctgttgattttgatgttattcctttctgtttgttagttttccttctaacagtcaggtccctcagctgcaggtctgttggagtttgctggaggtccactccagaccctgtttgactgggtatcaccagtggaggctgcagaacagcaaatattgcagaagagcaaatattgctgcctgatccttcctctggaagcttcatcccagaggagcacccacctgtatgaggtgtcagtcagcccccactaggtggtgtctcccagttaggctacacgggtgtcagggacccacttgaggaggcagtctgtccattctcagagctcaaacactgtgctgggagaaccactgctctcttcagagctgtcagtcaggtacgtttaagtctgcagaagctgtctgctgccttttgttcagctatgccctgcccccagaggtggaatctacagaggcaacaggccttgctgagctgcggtgggttccgcccagtttgagcttccagggcagctttgtttacctgctcaagcctcagcagtggcggacgcccatccccctgccaggctgctacctcgcaggtcgatctcagactgctgtgctagcagtgagcaaggctccatgggcatgggacctgccgaaccaggcgtgagatataatctcctggtgtgccatttgctacgactgttggaaaagcgcagtatttggacggaagtgtcccaattttccaggtacagtctttcatggcttcccttgggtaggaaagggaaatcccctgaccccttgcgcttcctgggtgaggcgatgccccgccctgcttcggctcaccctctgtgggctgcacccactgtccaaccagtcccagtgagatgaaccagctacctcagttggaaatgcagaaatcatctgtcttctacgtcgatcacgctgtgtgctgcagaccagagctgttcctattcggccatcttggaatggaagtcaagctatttttattatagaactgactgttcaatatttaccaacataccactatgtacacctgagagaagtgagtgcatatgtctaccaaaggctatgtaaaacaaagtttatagcagttttaattaaagaacaaccaaactggaaacaacccaaaggtccaccaacaggagaatggaaaagtaaattgtggtattttcacacaatggactactacacagcaaaaataaataaaaataacagtattgataagcacaacaagatggataaatctcacaggtcagttaagtagaagatggcagacacagaagagtgtattctacgtgattccatttttaggaagctgaagaataagcaagactagctgaagttgatagagtcagaatagctttcctctggggatagtggggttattgactgggaaaggacatgagagggccctctgggtactgtaaatatgctatgtcttgatctgagcaatgtttatgtgtatctatatataaaaattcattaaatatgcacttaacatttacacattgtactgtatataaatcataccttaattatgaagagtgtagacacacacacacacacacacacacacacacacacacacacacaccgtattcagtgaccctgtcagtaaggtggaagagttagactaccatcccagcagtacagaacatccaacaatggtgagtaccaagaagaagaaaggcagcctgaatcttggcagacaaatcagcccagttttagtgacatccaactcactgccatcgtggggactttcagcacctgtactggcagcaatgccgatgcatggagaatttgtctccatcagcacatactccccaggcacatcactgcctgggaaggaatccagtgaacacatcagctgtctctcccacacacctactgccataacagcagaaatccagaaatgtaaagatagggactttcatccaacttgggcaatattccagcatttgctgtcaacagagaacactgaagcctgagaccttacctgttgagatgatccggaaggttgcaaagaggcttctaactatgtctctaagcttttattccaaataaagtaaaagccaaacaaatgcctgcttcctttatcatcagccagaagaaaaataagagatcatgccatctcacagctctccattcctggcaggatgcaggtctaagtacttcttgaagagttacggtacattctcatcagcagtgtaccctagacccaacaagtgattagccttaagccttaatgaaaagactggactgtgtcccaaatgagggtgaagtgcagttgacagcatcaggccatctacactcgtgaacttgtttgggccacttggagaaatatttattgcatacctactgtgttcatcgtcataaaaatgtgcctaccatcaaaagattgagtatgaagagaagctcacaagatcctagctttattccctaacggttgagtgttgtgtgttcaaatatggctgtgtgaaaataatacaagacattggggagttggttttagaatggcttagtgttttgaggacactaggaaactcgaattccagaggctatgagaattattggacattttcttagtttgtgtttcagaagccaatcctgaaacaagaaatcaagtaaaggcagcttacttgggaggtgtagggcaaacagaacggagcagaggggagagaaagaaagaggaaggagcctaaaagggcatataattaagcaggccacttctgtgggcaactagagcacagtcacactgggggaagctctgggaaccagcttacaacacactcaccccaaagtgatcccacccatggggagggagctgggtatttataggccaagtcccatctgtcattggttgagggatgctcctaaggagtgttaattccccagcacttctggcctgccaagcagatggtgaagtgggctctgtgacaaagaagtgtgggtgctggcatttgaagtcgggcaggtgtgctctcaagagataagggctagaggatatgagcagggtgccaactgcatctgctgcagaggaacttaaagcaattggccaggaacttctctgcttgtatagtctatgactgcactttagaagtgtacatacagaaaattgaaaagccacacatcagctaaatctacatatctataaatctacagttgatagatggcacattaagacccaaacctgggaaatgcagcccaaatgtttaatcagtaccatggagctgaaagttgtcatcctgttctattacctggcttattgccttggctaagctgtccagatctataaaaaagtaaaggcataaaccttctgtctccttcaagctagtatgacccccacggttcagaccttcatttcgtcagtgaactagttgttacattggtgtcttattttgtctccctggttacactcttcatcctttccaatgtagctaccacactgcaggcagactgaacttcccaagacacacttctgatcatttcatccgctgataaaatctttgactggctcgcagttgcccacaggacaaagtctgtcttccaagttcaactaacaaggccttgtgtgattgggactttgcctgcccctctggctttcctctccgttttcctaccagcctgaattacttccatttcccctgacatcctttttgtgcctctgaaactttgcccatgccttagcttccacctgaaatactctctcaaccagttccacgccctgagccaaacctctgcccttaattaactcttcctcattcttgggtcctaatttagaagtcagttcatctagaaatcgtccttgatgactgcaaggccagtgtgggtgcccttcccttaatactctgcacttcttttgtcttagaactccacaaagattttgtagttgtcttgttgcttgtctttatctcccacagtttgaattttctgtgagggcagaaccatgtttgtcttgctcacatggcttcaggtaagatttactaatagtaactaataaatttcaatgaatgaataagatcctccgtcgtctgacccctgtctcctttccagctcttattctattgcacactcaccactgctacacacatgctcctggtacacacacacacacacacacacacacacacacccctgcatccccctcacatatgcatatatcctggacaccaacatactagactccctatacccctttagctattcctatcatagcactgtaacactcactggactttgtggttcgcttgcgctaatcaattctgagaatctgcctgaagtccctccactaaactctacgttacttgaagataaagttatgtcttaatgttctttatctctccagggcttacgtaatgcccagtatggtgtagtcccttaatatatgttgagtaaatgcatcattgctataattggtgatgaagtgcagaagactttatcagcatgacttctgattctcaacaaagcaaaaaacctctggcctcccacctgcccagtgtctgagacccatcacagacttcacatctgcaagccttgaaaattttcattagccaaattagcaaaccattgtcaccattaaagcaagatagaatcaccagagtgacacctttggacatgaaagcaatctttgctccgggctgggcatatcacttccaaaagccacatgccagtgagacagcttagtagaagctatctgtcaatttcagtagggctggcgtgctcagggaaggtagatgaaatgttctgagggtcctatggatgcactccacctctaaagtagcaagcaaaaccaggctgcaggataactgaatcttgcaaaaacatccgagtcttgacgtggaaggaagttgcaatagtgggagcataggtgtggttggaagtgattacagacaagaggagtttttccaaattattttcctggagacctttatgatgacaggatagtatcacgtgcaatattctaggttccatcagcagcagtgggctacaaaccaaaggactgtcacctcaggtcggctgtgaggcataagcagatgaagttacatcagtgcttgcatcgtctgagacatccagagataggaagggtatacaacctagtttgcctgtgatagtcccattttatgcctattgttcctgtgaaattaacactgccctcttgcactcccaaaagtgttccagtttggatgataaattatatggtcacactacccatcaacagcattaacaggaggagcagaatcttcagatagacatggatggtaggtacatagaaattcttacaatagtctccagacttctgtatttaaaaaaaaaaaaaaaacttttcaaaataaaaggaaatatgaaaaacaaatacacttgaaaaattcaaactaccctatgattaagcatagcacataattatttcagacctcagttgcctacctaaattgtttctctgctcttatttttttagattatagtttaaccatatccatttgtctaatgagatcagccatttgtctgcagcatgtaagcaacaggagcaaattcaatgtcatctgtttatttaagatgtaaatgatatgcatgtagcacagtagcctttgggtacaaatgaagtatcattcaatgtcaccggagaaatataaatcagcaagaaggaacaaacactaaaggtttcatcagcacatctttgttgtgctccttttatgtgccaggcactactctaggtacttgggataggattgagcgaaacaaaatccctgccgtcgtgaagcatatatattctagtgtaaaactccccgtggggagagatgatacccaagtcctataagacccccaacttcaatctgatattttcagtaaatccacacaccgcaagcccctttatacaaatatgttctgtaaagttttgttttgtttttttctttttcgtcgtgtgtttctgaggtcaaggggttatataagaaacatacatggccgggtgcggtggctcacgcctgtaatcccagcactttgggagaccaggacgggtgaatcacctgatgtcaggagttcgagaccatcctggccaacatggtgaaaccccatctctactaaaaatacaaagaattacccagacgtggtggtgagcaactgtaattccagctactcgggaggctgaagcaggagaatcgcttgaacccaggaggcagaggttgcagtgagtcgagatcatgccattgcaccgcagcctgggcaacaaaagcaaaaatactccgtctcaaaaaagaaaaaaaagacacatacatgatgcaaaagatgctattttgactgatgaaagtcttctcccttttcacatctgttttcttcatctccagctgtttgcgcatgcttgtcattggtgatgggcttgtggcttctttctgaggtttctgttgtaaatatctggcattcactgggttttactgtttagtactggtcggagttttgttgcttttctagactgctttgtcatgtttgacccccgactttgctacctcatcaccatctcctgctgtgagttgaccacgtttaagcctaataccagaaagcaaatttatcaatatccaaatgtccaaagcacagagattaggggataaagtctttacttttccagaagaactctcattaggggacaattttctgagcccaggatttaaatctgggctgatccacttactaaatttgtggccatggacaagttatttaagctcctagaggctcagcttcctcacgcgcagatggaggggtaatatctacctccctgatttgctgtgagggttaaataagatgatagattgtagcattctttgcacaatgtccggcacttagcaagcacttagtaccttttagtttccttcttttacccctaccatcttttcctgcctagactggattcctttaattgatgtgcacagttatctaactagagagctaacctgcagatgatgggacaattttcaaacttggagcttatactgggattaaggagggccaactttaaacacatactacccagctgttcccttcaaatatttgtactgatccatgcttctaaccccatttaccccttagtctttcagcaaagatgagagcaaaaatcggtcacctttacatttcattgaatatacttttcaagaaaaatggaggaagtttcactatttaaaggaaaagaaagttgaagtagacaagacacaacagaagatagaaatggggttttctgtttgttcattttgtctttgctatcagacatttactgggtaccacctgtgtttcagagactgtacagagcaatttacattcaatttctgatttatccttcaacaatcctaatgagatgggtactattattggccccattttacagatgaataagctgaggcaagggatagccattacataatagcttagtgtccaggatcacacatctccttagtgccaaagctgggatttgagcctaggcagtctgattccatcatgccaaaccatgccaccaacatcagcacctcccagaagggtcgaggcctttgcaagccgagtcatagaaactatcatagtttgaccttttgccctgtgagacctcttttcagatcaggaaagggagggcagtggctgaaatgctcctgtgatttttaagggcagtagctttgtatgagaaccttgagaacagagaagaattattgtcaggaagaaatgcactgtcctataatacgttattttatgaattacaggtactcatccttggtaaggcttatggtccatcattaaggagagctgttaccatatcattaggtggaactttcttcttattttttctttcatcagccataatttccattgttctcaagttcagtgcccattagaaacatagcaaatcctttcaaagaaaaaatgttaccaaagagctcatctgatgaagacatttgtatattttttgatttaacagtattattattcagtttcaaatatcttggggatgtgggttatatggcattttgatttttttcataagttaaaacgacgggaatgagaagatttctgagatccttcctagcccaaaactgttgtcttttttctaaaatcctgccctgataccaccaaactgtctcttggaaaccaaacaaaattgtctgatagccccctcaggaagctcaggttctgacaggactcttggggaggaggagaggcaggaggggaaagaacaaacactgacgaaagctcaggtaggtgactcacataaaattgccgctattcaactactttttaacctatagaaatggcaatttcatatggtttaacctaatactaaatgccaggccagacaccttttataggtaatcataatgactttatgaggtaaggattattcccataattcagataacaaaactgaattaaaaatctaaattcactgtcttagttggacctcccccagaagctaacctggagtcaagcacttcatgagagtacaatatttggaagataatcccaggaagcactgagaagagaacagcatcatgaggcagggaagaaaagccgtcggctatggaggcattgtcaagccagctactctgtgggcaactggagtttaatcctgctggggaactctgggaaacagtgaggaacacatgttgtagggttatcccatttaggaggacatgtgagctgggctgttcatacacagactgtctttagtcataggtccagcctgcttagaattgagatagtatgttagtgccccagtatttccacatcaggctggaaatagatatgatatgtgcactgaagtggtaaggatgaggggatatgcgcagggcccagctgtgttatgaacagaggcaggatttgaacttgtggcattctaacctcataacccatgtccctcccacaaaagcacaagatattgtcaagtcgggaaggattaggggctccaggactcaattgtagattatgtttggaagctgtaagaccactcaccagaggagctagcatccatgcttcctgctgtataataatacaattgtatttgtgtagctctcaaaagttgacaaaatgcatgcacactcatcatctcatttggctttcatcatgcccatgatgagacaaactaaagtccctttactcatgagattattatattcatgtgtttacttcacaattgttatgtgttccaggcactgttctagttaatggaaatgtagaggtggaccaaacagaaacacattctggcatgacagaactcatatttgaatgggggcagcagaataaaaacagagatgatgataatgtcatgtcatgatggtaccatgaaaaaattaaaacaagaaaagatgatggtgatgggcaaacatactagtgtttttttttttttaaattaggggtgagctcaggaaagatgattgcatttaagcagggaagtaaaggcagtgagaacagaagttttttaagtgtctggaagaagaatgtcccaggcagaatcaagagcaagacgagcactgcaatgtgagaatagcgagatgggagtccagagaagagaggtcagcaaggagaatgtttcatgtcaggcgccaaagtcaatgctctgagcatgatgaggaactctaggggaatttaaagcagggaagtgacgtgttttcataggttcattgttttgtttatctctaagtcatgtggtcagcaaaacccagaaccaggactaaaattgaagccttctgactcctgatacagtgctcctcccattcaggtccatggttggtcattctctagacctgaatgtccttggcatgctgtttttcctgttcctggcatggttatttgtggtctgctaatcaaatcttgtaacagctgttgcctgttcccaagcccaaacatttggttccttgggactttcctttgccatttgtccagccaatcagctttaacattctcctgtttctgtgagcatcgggtcctcttagagctatccaacaaaactcttcacccacaagctagctcaactacagcttaagcttgaccatgaaactcaagtgaggatttagggaatttaaaaatagccactctatcagccactctaaacattctaatcagaaagttcaactttacagactgccaagtatcttcataatatgaaggattttttcacaaatcaagaccaagtgaaattttctcccagactacgggaataaagagattgttgaacctgtggttcactgtactgactgtcttatccataccagtgtggagtcaggcagaagttgcaatgagatactgcaattgcattttccttcaccatcactattttttgtttctaaaatctcagatttctctgcttcaaatctaaagctgccttgttttttcagccaagcctgcaaagacaaactcagcttgtttggagagttacaataagggctgtcttggctgcttttcagtgtcagtacccgcaataagagtgtttaccaccttgtagagtaaggagcaaaacagaactattcaactctcccagacctgcactagcattgcattactgacagaggtaaccatttgtcttttgtcactggagcaggtgagcatggcaccaggcacacatgtgcagaggaagtgtgtggatagatagtcacttgtttggctatatccacagcttaaatttggtgtcctctggaaatgtaatatttcaaaggcaggatgatatttctgttcacttattaagggatgactaacttgcttttggctgcactacaaatgaatcacggtaacaatccctaacttgcgacttctggtgttctgatgtaatgcatttctattaaaagaagaggaaagagagtgggtgagagtgagatcatgcaaagacagaacataacaccaagggagctagcgtaatttatgaactgctgcagccagatccatccacttcaaggtgttttcttgcgtcctgagtgaggataccttgccagttagcacctgcccatttacagttgcagaatatagacccagatcaagacatgtagtttggagggattcagtgaagggaacattttatttaggggtgaaaaccagatattccttgaaagcatttttaagcagttttgattgtgtcacttggaaggtaatatttggggacggatgatataggttaagaagtcaaatcataatcttcctttttacatttttttaatgtatgcagcttatttgggagtagaagaagtgggaagggggtggaaacgtgagacaaggaagggaagacagcctataaagggggtgtcatcaggctaactcccactggaggtgactggagctccatcctgctgcgacatggggaacccatacgaactccgagtcttccctcacagatgagattgcttggggactgtttgaggctgaccccagagcatgttaattgccctgcatgggcagagtggccttcctccttccctcctcccttttcaacaagaaacaaatacaaaaaaaaaaaaaaaaaaaaaaaaaaaaacccaaaaccctgcaaggtattgtataagatcctctaaacccacaggtatttttcctgtgttaatcaccactcaggagcagatacatccttcctcccttctgtactgtcctctgcaaagtgtccctgctgtcttctgaggaagatctgagtgtgccaaggagaggcagagaggaaattagactctggcctgtcgtgaccaagcagcccacactggctttgtcccaggatctggcagaaggggattataagagccaacgcctccccagaatgggaaatcactcagagagggaaatcttttttttttttttttccagtaaacctatattctttaccgttttccttctgggtttcatctatcagatcggattgccctgaaaaagaacttcagtgtgtcagaaaagcatacctcaagtagccgtaataatgttcaatttgatatttattaagttaactttctctcacctggtgtctgattatgtagtttgtggatatcactcatcttagaattatgtagtgttaaaactggaagggtctgtccttaaatattagctagaccaacaccctttttaactgataaatatgagaactgaagtttcagacttaaagaagcagagtgggattcctgaagtttctgacactcttaaggtaggtagtggaagcgacactggaagccaaaactttttcttactggattccattgtgccccaggaccttttttcttaggaagcctgtctttgaaaagctttatttagcaacaccagaggctggatggagattaagaaaaatcgttaaactctaaacccatccccttcgttacctgttaatactgccatgtaatgttgctgctgtctgaacatgagtttagctgtttggattatttctggtctctcttattggaccccagatctccaattgtggccatcccatagctcaatcatatccactgccagtcacttgaagcaggtgggctgacaattcttttttttttttttttttttgagacggagtctcgttctgtcgcccaggcgggagtgctgtggcgcgatctccgctcactgcaagctccgccttccgggttcacgccattctcctgcctcagcctcccatgtagctgggataacaggcgcacacaccaccacgcccggctaattttttgtatttttagtagagacggggtttcaccgtggtctcgatctcctgacctcgtgatccgcccgcctcggcctcccaaagtgctgggattacaggcgtgagccaccgcgccgcccggccgggctgacaattctttatccacccccaagttgtcttcatgctcactgctgaatttgttggtgtatgctaagtgtcctgctgtggagtaagacttgagaatcaggtctgcccttatttactggctcatctcaggtaagtgattgaaagtctctaggcctcagttgcaacagctataaaatgaggataatagtatcaccattgccacagagtctgttttaaatacatttttcaactgtatagaaagcacttagaaaactaattactattatcattatcattcttaacctgaagaatgatgagagcaaagaagctaataatttacgtgatgtgttcagagccttaaaactaatctcaatctaacattcagttttggcctctttggcagcaaatacaataacaataaaaaatattgttattgaaattgacactggttcgggctttactagtacaaagcacttggcgttgtttactgttaggagtttccctttgttttggacactgcatctcatgagattttttccacgcgcgagtgcaagcacgctaaattcaggaaaattatcctattattgacagcatagtagatttgatgagtacctgttgaatgtgtgttgaatgaataatctagaatctatacatagttatagaaacatggattatatgttatttcacaccacagacttagaccacattaagggtcaggacaattagtttgtgtcgttttttccttcgttttcttttctgagaagagcgtctcttacctagttcaataacaagcttatatggatcgcagttgtccattttgtggattatctgaagcatagcttcaaaccctggctttcttttccctctgtgaatatatctggtactacagtttagaacatccactaatgtttctactgccttgagtggggttcttttaggaaagtaaatcagggcactctaaaactcggtataggtagatgttcaggtagcatgcgcagtatatctgcccacggctatgtggatttccaagagtggattgtgtctgtgcttatgtgtattcataagcaccaaagatcagaactgagccactgcagaagtcacagaagggagtctcaactccttattataactcttgttatcctctcacctcttattccacagtagaatcctacagattccccctgctaggtgggtggcctcagccaacaccctctctctggctgctttgtcactctgcagaactctgccactcagaagcaagagtgacatgttctacccaccactctgtcggaaagtcaaggcagttgcatcttacagcagctctggaagtgagttaagaaaccttccctctcaaacttcattaaggttctcattttccaagattccctcctatggtcttgtagtacgcgggttaacatggtgtctgttttcttcgatgtatggtcctggggtcatagcagtagatctgcacagttggaagatccctaaagagtttacaactccccacccagaagggcatggccgtcatagagaatggatggaaaatatccccttgctataattgggttcagccctgtggcttaacaccatcttatttggcaatctttttctcttgacatatttagtaatcactttaagggagatttattacactgctcatgggaacaaacaatgcactaaatattacacttaggcatgctttcaataccactccttttctagcctattctgaatcttttcccaaagtctttcttcagtgcttatcaaaactctctcttgtctttaaattcctctaagttcttctttcttccaaaataaccttttataatttgaaatattttgtaactaggagttcttttaatcaaaattcactgggccatgcttagagaagaattgataaaaacacactttcacagcttaaaatcatggaagacattttgctcaccattaatcccaaagcatcaaaacaaacatttagcatatgattaggctgtgaaaatagcctcctaggggtgtgtgtgtgtgtgtgtgtgtgtgtgtgtgtgtgtgtgtgtgtttacatatttatataaaggaattcaaattatttcagccaaacataatacaatgaaatgttttctgatcctgtgggttggtacccatgaagagatggggggcaaggggccactgagaattaggattctccactcatgctctgtgctaatgaaagcactttgacagctagtgcccctcagacattgttttaaaagcataatatcccactcatccaggcacatgcgcagcaaaatgtcttaacagatagtctatttagcacagatttgagagaaaatatatcaggatcatggagaaggtaatgagttgtagtggcacagctacagtataacaactctgtgcatgttaaattctagcttctttacagatgaaatgtccttcattcatcagatatgtcataatggctatctatactcttgagagagtccactcagtgctaagcacagtcgtagatgtactagtttacttaacactcaactacatgtctgtcactggcctcattttgcacacgggccacattttatacagagaaagcaaagccaccatgaggataagctactggtgagtcaaaacagttaaactaaggacctgtgtagctaccactgaaacagtaacatgatatgccattttcaaaaagacagtgatgagccccgccattcctcctacctacatggcctccctgagccccagttttcttatctgtaaagtgacttgttgagagaatttaaggtgtgaagccctgacacgtggtagtagctcatttaactcccttactcccaccacacccctcgactaccttgttttcttatcttagacagtagattacacatactcgtacatatctgaaatagagcatttgtgacttttaggagtggggcagtaaaagcataaattcagaaattagttgctaacaagaaccttaggtattcagatggctagaggtgtatggtgaggggccaagagcacaggttctggagccagactgcctggtatagcccagctctgcctcttactatgtgtgtgacattgggcaagtgacttggcttctctgtattgcctcatctgtaaaatgaagctagtacttgaacctactttgtaatttgctgcaaggattaaatgagtttatctgtataaggagcctagaattgtgcctggcatgtagtaggggcagttaaattagtgcgtgtattctcctgcatattttgatgacaagcattcagtacctgggcacagcaaattcggtatagagcaaggtgtgtagaataaatcccattgttctcctttagcatgattcccatatatcccagccaggctcttacagttatagctcccttcccatacatgtaggcaaggaaagccagagacaacaaggaccctcaaggtaaacctcttgtcttatatggtagagagagacttaattggatgaagagatcatttagttgccctgcaaatcggcattaaaggacgagccagcagaggatctctgcatttggaattgcaccttagttcactttctatgttacattttcaacagggacactgaacaggggacctatataagacttcccaacagtatagaccaattgggtcacaaataaagaacacgtggaaagaatactggtactttaatgcagcatttctcaaatgtcagctgcatcagaattcttaagagggcttgcgaaaacccagattcctgggctacaccccagaaattctgatttaccaggtctgggatggtgcctaagaattttcatttctgacaagctcccaggttatgctgctgctgctgttctaggggccacattgcgagaaccactggtcaaatgtgtgtttcacattcctactacctatttctgatctaggtttataacatttgatttgaactgtttagcttagagacggaatgtccaccctctccaaaaaataaaaatagaaatatttgattaataaatgctgtcatttttttcccccacagttgcatgctgctgtcaccaagatccaggttccaaggcctggttttaattacacgtttgcccatatatgtatcctgaataatgataagacttgcatcgtggatgacatagtgcacgtcctggaagagctaaagaatgctcgggccaccaatcggaccaattttgctatcacatacccaatcactcacttaaaggacgggagggctgtgtacaatgggcaccagcttgggggcgtcactgtgcacagcaaagaccgggtgaaatctgcagaggccatccagctcacctactacctgcagtcaatcaacagtctcaatgacatggtggctgagaggtgggagtccagcttctgcgacactgtcagactgtttcagaaatccaacagcaaagtcaaaatgtacccttacacgtcctcctcactgagggaagatttccagaagaccagccgcgtatcagaacgttacctggtcaccagcctgattctggtggttaccatggccatcctgtgttgctctatgcaggactgcgtccgcagcaaaccctggctaggcctgctcggattggtgaccataagcctggccactctcactgcagccgggatcatcaatcttactggtgggaaatataattccaccttcctgggagtccctttcgtcatgctaggtaattactactcttctttcttctgtttccgcctgctggtggtgttgactaggttcctaaaaggccaggagtagccttctaacaactttgtttcatttaacagtatcttcattttgcccaaaagtcctgggacccactctataaagtgctggtaatcagcaaaaaacaacctaatctggtaaatgtgccagaagttcaaagtcctgggttctagcgctgactctccattgagcagccatgtggtgtctagcaggtattaatcttctccttgtcccagtgtcttaggttgggcttccccataagcagggccctgagaaaaagatttggatacaagtagtgtatttgggaggtgagcccaggaagcaccagtatgggagtgaggaagtggaagttgaaggcacttcagttgaaggcaggcagttgaaggtatgttaatgagcccaagatatatcacattctgccggttgctgtgggcacctgtggttcagccccacaggggacctttgggagaccttgtgaaacacacctcagagaggtcctcccccggggtgaggaatttgggctattttcccacagaccctttgtgattcattgagggctgctccccaggccagttaactgccagcacttcccagggaggtgctcctgcagcacactcctgcagccagagaaatccttcaggtgactttgtagttataagccttcagcaagctcaagaatggggaatgggagggcatgttgggttggcactgagagcgcctgctactctcagtttccccaccttatgaatagagtggatgtgagcatcacacaaaaggacatgataaatgtataagaactttgaaagtgacatgtgagataccagtaggaagtaactttttttcctattcttactatgaactcaggagaatattttaaagcgatgctgatggtgacagcgtgcttccagtgtgtccactcagggggctgctggaactccctgatagagattaatggtcaaaacaaagccatagtggccataacatcggttgccctgtccatctgttatcgaaaatggcatgcccagcaagcctgatggcagggttcttgcgggccaaggattcaagaggttcactttcccccttttctatggtagcttctcatcaattcctttaacaaaattaaaatgtcatttggaatcagatactcacatgacaaatgaagtggcattttttggttaactaagaaataaccactgttgaggtcattagcgtgccttatgccctgttttagagtagtggaagagaatttcctcaggaaatctccgctgtgttgtgagcacacgataagcggggctggtggggctgcaaagccacagaattacattctgccctcgattctctgtggcccgaggaattgaaacctagtcaataaacatatactagtagcttttgtgaagagctgggcactgtaaggagaccgagcagcctgataatttgataatgtacttgtcactgctgaaaacaacagagaagaaggctgccgtacctcctcctgaattcggtctattaagaaagcagcataacctgccgctttaaaatcaccccaagaccgtgtgggttgactgtggaatacagagtggttccttgaagagtgagtaggactgagtattagtagcttccacagaggcttgtatcaaggttgaaattaagatgttttgctcatgattagtcacaatcttgaatgttttgggggttacgggaagggttttcgtttcgtttcattttttagcttttcattttcttgctgcttttgtgggaggaagagaaataggaataagaaaagagtggggaactgaagggagatcgtaaggttctcaaggtgaggcaaaaggacgccggagctagaaaaaggacaatcagtgctgattttatgacattccaggttgttaccagtgagctcaaagcatgttagaatatttaaaacttgtgaaaagttaatttactaagtaaaataaaattataatatttaaagtttcttcaaattaattttaagtaaactaaaatagcagtattcaaaacttcgtttcactaaaaaatgaaattgtaatattcaaaacttcttaaagttagttttataaagtaaactgcaatattttaaatttcttaaaacttacttttttgtactttttaaagaggttttaaatattgtaaggcaaagtcaacacaaaacagaccatggcagatagtattggtgcagggaaggatgtaagagatggtaggatggaaagatgctgttagcagggaaatgtctttaaaaaacaaatccagaaatagtaatgccacagatccacaaagactgagtatcactgaactttacatcacagttcaattcagaaaaaatctagcatttgcagcgaaagagaccacgcaccacaggtgcccaataagcccttgtttgcaatttctgaggaatgttacgtgcattgatttgatggcagttttccctgctgacaatcagtgtgcaacctttctgtacattctcagcccaaagagttctcaaattacttagtcataacatgaaaggaagctacatgttttaatagctaaggcccatttacaataaacactttgcacgatgtaatgggtgcttaatatgctcataaagctaacagtgcctggatttaggatggtcgccctcctgtatttctcagataaactcttcatttttaagagtttataaaatgaaatataagcaagaacagcttcataaatgttgcattcaaggccatcgtttaattctggggtttttggatgaccagtcctaaaatgccagtaaatatttcaaatgaccaagaagaaatgcagtgctaagagttttggcactacagtaaactgtccagtgtttaaattttcctgtgtataacttaaaatggctatgcttaacctaagcagatttaagcaaaacttgatttagtatgttatataaatacaatatcaaatcaaaaagtatatagcctcatttaaaaggtaaagtatcttagaaaaagtctcaaacatggacatttccttggctatcaataggtctatactgtgataaacattatagatttaaaattcaacaaactgaacattgtcagtgtgattctggtcacataggccaaatccagccaaatgccaaaatgacactagatttagaatggaaaattttaagatcacatgtgtcaagcagtattaacctgacaaaattccagaagaggaaagaatttggataaactcttaagagttcaccataatgggatgtgactgtgtgtttctagccaagatgatatgtgacagttctggcaataagaatatatcctacacagatgaatcattttggcaatgatgtaagcatagatacatcatgatttagaatgtttttaatcagtgttgtgcatactagacaatcccacttctgccaaaacctctgtccagatgagtcatatcagtttatttagagctgaaatcctaaaaggtctacagcgttataaatgttcatcgacattttttagttactctaatttggagaagagtttatttggtctatacccttatcgtgcataaaataataaccctttccaaatatattgatatcaagtagtgagttacttgaattgctacttgtgaatatatgatgctaattattttaatctgtgatggaatttcctttaaaggatgaagatttacaccattattctccagttgggtatgatttttaaaattagcataggttttctgtgtgcaagctctccttacaggcttaatgtttcaacagctttgctgatcagatacaaatcaggaaagggatagaatgttagatgatgtagaagggaaccaaaagaaagttttctcccttctgcatctggaaggtttgttgcttcatgtacatcctgtacagctaaaaaggagaattgaagtcgtagtgaaagagttcggatattagtttctacatgcaatctagtttataaaggttgctttgcatttatcaagatacaagagccccagagatttatgagataaaaaatactctttaagccctttttcaaatgtttgggattttgaggtcagatgtcagatccagggtgttctcttccttttgaattatccaaccaggccactcagattcaaggacgtgaaaggaagaaagaattagtggattatttctaatttgcggattagtgctaggaaaagaataatagcagggaagtttggcttcttttagctgtgcattttaacattattcatatgtagcagaaaccagaagattgggttccattctccaagaatttgctctcatatgatgccacttgaaatataatgcagtatatggagctcataaaaagggaaggaaaaaaaattctcatgcaaaacatttagttccaactgaaacattgaaattcttattttttctctaaacttaagcaaacctgaaagaatttgctttcctgatgagtattctgatacatttcaaaagtcatgagaaaatgagggaaaaatcagtcagataataataaaatttaaaccatatgaaattgcaaatatccaaccatttttggcctacaaacttggtaccattatctggtcatttttgagctacaaaaatggtaattttgtgtggttcagcctaacacattattgtagaaatccattatttgcaacaatatgacaattttgcctgatggagtagaagtatattagaatgctatggaaagactttgcttagatataaatcagtaataggttcagcatgttctagagaaaacaactgatttatgagggttttgttgttcacatttttgtgtacatctatttttttaaaagagatcatttattttacagtatttccaaagtttgtctctcgaatatcgttttttgtaatggtccatggtcattatgggactaatttacaaggagattatgtaatttaggcttgtaattcgttcttgcccttttattcttatgctccaccaatcatattagggtgagagtaggtggaaataaataggtttaggggaatggaacaaaacaagttttattgttctatttttaaccataaagtaagacaggaacaggacttgggggcacaagtccaggaaagcagaactcagtcagaggaatacaaaggggctttgtctttgacccaggattcccagatatcccctgggtggtctgtctacccggtcgtgcccagggaatgagggagtgacagaccctgtaaaggttgggcagcaagaggcaacatcaggacactgaactaaacatagaccctggggagaaatacctagtatctacatttggactaaactctcagaaagtcacagctgggcagtcttgaccagatggatatacagaagctcacaaccgaaacaggttcacagttattgtcaaggaaaccctgcatttcaccaaggctactttattactcaagaaccaaaatatagacagatggagcccaacagagggattctatagccccttctctacactgattggtgtagcaacactaacattattttgcctcatcagtaaaataaatttcacatcagcctactattcatcttgtgtgtatgtgtgtctttatagcctatgtgcataatatatattatatatcacattagctgtattatatatcatatgcaatatgatatgtagtaagctcatgttatgtatttatatgtatacaatgtgtttataacatatattatgtaatatatattgcttgaatatttaaatagaagctattctctgtgtatactatctggtatataggagtccaacattttgtatgtaaatatataaaatatatttgaataggatatgccatatatacatatgtttatatatcacatttgtattctatacgaaaagaaattaagcaatgaccatagcatatattatgggccacatttatacttatacacactggtcttatataatgtacatacacacaatatctaaatactttaaacaaggaagagctataagcaaattcatttctagggctctcttttacagctatctagtgaagaaaaatcattcctaagactaaaacccaatgctctggttagaattttcaaaatgtgacaagtctctagtacaaagaataagatgtgtgtgttccccctgatgtgagcatctgtctttacttaaacagagtacacctttattcttactcttaactctgagacaaaacaggctgcaataaaccaaacaattcagcttgtaaagtaaatgtttataactggcaaagtgtaaatgtaacccaattaataaacttctccctgaaaatagatgttactcaacccagacatatatacactttaaatttcttctcaaaaacacaaaaatcatgaatttatgtggatgacattgaaaaacaggcatcttataaacatgagctacttagtgaagcttttctaagaataaaataggctttaagcagattttgcttatggattatagtctctgaatttttgagacgaatgtagtaattttatttccatatatgaaatttggcactgcccaggcatgctataaacagcttcattgactcatgatattaaatgttttcacactgaaactgaaagatcatccatcaatcagcaagccatcccatttcctccttcttagccattccttactttgaggaactcaggatgaggaaatcctgctagtgtggagaggtttaaaatgtgagtagcacccagcggcatctctcagctgctgtgttgtggctatgtatactgggacaggcgcgaaaatctgggactgaagaaaaatctgacttacaaaatccagaagtattatacaaagtagatcaatttgcctacgattattcattgaaaaccaaacaacaacaaaaaaatcacccagactgtctccaatagcaaaaccactaaatacatttaaaatattattcactttatgagcaactttccagaagtatatctactgggtaaagaaaggttaactctcaactatttgttagtagattctgtcttaccggattataaacaaccctgaaggctttggtcaggccccagaaagttctgggtgacagaattaatctctgagggtgcttgatagtcaccctcagtgatgggaggattagccagttgaatttttttttccgccattagtgttatttatcatgtgtgcttctttttcccttcatttgctccaaagtctgagagttaacaacacattcagatataaaaattcttttgagaataagaaaaattattagcctaaattctttagtattttattttattagatgacaaccccaaagtgtactgcaaataaaattaataaaagcagttttctttttaaaatcacactcccggcccaaattttgcctcaacattagtgaagagccctgctggcctgacaaaaacctcgagctgcctcagagtattcactcacgaataattagaacttggcgctcccttcaatctctctctctctctttctctttatgtgtgtgtgtatgtgtttttacatactgatatgcatttgttcttatgcatgtaacaatacagacatgcagggtaacaaaaatagaaacaaacatcttgaatatgcttttaaaggacaagagaatgctttagaagcatttttatcttcaaaatctgatagaatcagtatgtgtttaacagttcccgttggcaactcctcagtcctgcactgtgactgtaaaagaaggaatcccctgggatgttgtatcatccagggtaatccttggaatgtgaggatgtcaggatgtggaggttcctgatatcctcactgtgatatatagtctttttaccccaaggtctcaggctgcgacctggccctcaaatgatgagtcatgactcccaataacaccacagggtccctactgaccaaaatcaaaatctgtatttaggtagctctgccctggccccaccccatgagttctgtcaccagggagtccttgtgaacagacttgggactttggagatgggaaattgttatttgccaaagtcatgctttgtgccaatgacataggcccactggtcagatttaacagagaagcttatagaactcctactttgtagagaagtttttaaaactagagtgcaaagcaaacagcagtacttttgcttttaaaacacctttttaaaaagtaggaaacaacagtcagacctctgaaaagtatcttcagtccacatgcaatatctgtttgcctacgtctgtaagatttggcgtcagagttccgcttgctgaactacagccccaaaattaggagagtgggttgtgcgtggtggctcatgcctgtatagaatcccagcactttgggaggccgaggcaggcagatcacctgaggtcaagagttcaagaccagcctggccaatacggtgaaaccccatctctactaaaactacaaaaattacctgggcgtggtggcatgtgcctgtaatcccagctacccaggaggctgaggcaggggaatcgctggaacccgggaggccgaggctgcagcgagcagagattgtgccactgcactccagcctgggagacagagtgagactccgtctcgaaaaaaaaaaaaagcaatgaatgatgatgatgctaaaggaggtagccatccactgaaagaggaaagtggagaggaacagaacctaccaaaatctatcttctctgcctctccttgactccaggtggcccagtttctggagtgctagtaaaagataaggtcagacctgactgaaggaaaaactgaagaaattcgtctctgtgaaattctcctacctgccatttcctctttattccattcccatgtccattctctgtcccattccccagacctaagggaagctgcttcagtagaccactgtcccagaggagtttacatttaaaaggatacccttgaaagttccaaggggaactcggatataattccggcattctggagggcaggatggtcctcgtgtcctagggcttttggaatgtgtctccccttgaatccaggccagaacacaagagtcctcaccgatggcctttcctataggataacaggccgacctcttcagcaaaaatacccagctatgagccaggacagctgccagccaggcactccaggctgttaatccttaagaggtgaccacagctatgttagcacttgtccctcccttgactgacaaaccttcaggaaggaggcccagttatggtatcagcaattgtcccagaaatccaaagggctcttgtaagatgctgtagaactccagtttggggattcgggtgtagcaatctgctcgagaggtgtggcttgagaaaggaatctgacctatcaggaatggtggtcggggcctttggaggcaaagtcaggcacaactagcaacaaatgctgagtgatcggttagaacaaattctttctcagggcctcttctgatttctgtgagtggctgcatgtacacacctgtagcaagaaggaagaactaaggaaaggcatcgtttccaaaagcccctcagaagaaaattagaattctctttggagctgcccccaaaccaagaacatatgcaaaaagagccaggactcaaaataaaagatcaaactatagaaggacaaggcatttaaaatgcagcaacagaactcaagagagaagctaacagcctacttccacctttccttgattttgattactttcattcttgaccctggagcctcagtcttgtcacctaatatctctgttaattcaaattccttttctcaattagcttctaagattattcaacagcaaggtatgaaattgattcttattgtattttccaaaaatcagggtcagataatgtcattataaaacatcacactgatttttaaaagaactgcaaaacagatttaagttctattatatgactaattctaattccgctatatgctttattttcttgccatatttaataactcagtactaaaaccctgtttaaattttttgtttctggcaagtaaatatcattaaaaaattatttgccatttatagtgatcccctgaagtgtgctttgcccaccaaagcttacttgctctacatggccccaggaaaaaaaaaaaaaaaacaaaaaaaacaatattatttcttcagggacagtgcctcagaagtattctctttttaccctcattgtcaagagaatggttacttaattaaaggtcagtgggtccatcttgaaaatatactagaaacagatttaatcatgttccctctccagactagatgttaatacctaagcataattaacaacaggatgccagtcaatgagtgtactttttacttcatatctggggagtttaggtgccttcaatttaataggggcctcggtgctagttaacaaattgacagtcttgacctgacttctaaaagtggctgtaaaacgatgcctagtcaattaagataaatgccaaattcctctgaggaaacaggcctaaatcattactttgaaatgggcatttcaggtatgaggccaggacttcacaataaggatataaatactagcttgggcatgagggaagatgtacacctagctattgtacacacaagataacagtgactcactttattcagcattatgcttggctggagattttaaattcctttttaaatacaagactattgtaccacagggtaaagattttattatcctcaataatgggattgaatatgccaaggcgatggaagcaggaaattagatctgctgatccccattgccaagacaggagttatcgaaatccacaacgggtcactttggtgagccttccaatgttgcagtggcctggaaacacagggactcgaagtagggaaatgtctggctccaactacgagaggtggtagaagtcatgctagatcaggttccaggcagcagaatggagtttagaacatgagcatttactgtacctctgctatttcagtattgctgaaatactaaaccaggaggcgaaggcactaagcagttacgcagcggggttactgatctggctctttcccacagatgccactatcaaatagcgcggagaagctagcagagtcgctgctgacgtattatatcactgcttgataagtcatgtatgaataaccaaattggtcaaacagatccctgaagacaaattgcaagtcataaaccttcaacctgaatcctaatttttatcaataaccaggagagttcatatttatcttattttttctgtattttcttcactgaaacttcttcactcctacttattttgcttccctctttctaagatttattgcttcctgccctgatatttggggagggaaaacagagggggctgtgatttagtttcctgtcaagactcaaatgaaatacactgcctctttatcactaaaaccctctagttggcaaattttaaatgaggtgacaggacattaactcagaaccctctgcccactatcttcctctgcactgacccctagccagacttgtggggacggaaagcaaaatgatgagtgtccagacatcttctcttctctggagcgttccaccaaccaaactgcaccaataactctaagctattaatgggaaaaatccccaagagacatatgcacaagtctaatcagcttttattctttttagagtcagggtcttgccctgttgcccaggctggagtgcagtggcacaatcatggctcactgcagcctccaactccgaggctcaagagatccacctgccttagcctcccaagtagctgggactacagatatgagccactattcctggctaagttgtttcattttctttctttttttttctttcttttttctttctttctttctttttttttttttttttgagagatgaggtctcgctacattgcccaggctggtatcaaactcctggtcttaagtcatcttccttcctcagtctcccaagttgctaggattacaggcatgagccaccatgactggctctactcagctttctataggcaaaagttcatctaagtgctgtttgtttggtggaacactccaaagaagagaactttcttaagccagagggaatatgaagatctttgcttctctagctgccctttcgttatccattaacatttacgattcataaaaacatgggtctatctccgcataggagaaatcattggcatttacatacccgtcaccactagggttgattacgtttcctttgacccagtagtccctcataatcaagttgatttccctcttaagagattagttctttaaacttctgctctggtctttttctgccctcttaggtcatggattatatgggacttttgaaatgttatcctcctggaggaaaactagagaagaccaacatgttaaagagagaactgcagcagtctatgcagactccatgctctccttttctctcaccactgccatgtacctggtcacctttggcataggggccagccctttcacgaacattgaggcagccaggattttctgctgcaattcctgtattgcaatcttcttcaactacctctatgtactctcgttttatggttccagcctagtgttcactggctacatagaaaacaattaccagcatagtatcttctgtagaaaagtcccaaagcctgaggcattgcaggagaagccggcatggtacaggtttctcctgacggccagattcagtgaggacacagctgaaggcgaggaagcgaacacttacgagagtcacctattggtatgtttcctcaaacgctattactgtgactggataaccaacacctatgtcaagccttttgtagttctcttttaccttatttatatttcctttgccttaatgggctatctgcaggtcagtgaagggtcagaccttagtaacattgtagcaaccgcgacacaaaccattgagtacactactgcccagcaaaagtacttcagcaactacagtcctgtgattgggttttacatatatgagtctatagaatactggaacactagtgtccaagaagatgttctagaatacaccaaggggtttgtgcggatatcctggtttgagagctatttaaattaccttcggaaactcaatgtatccactggcttgcctaagaaaaatttcacagacatgttgaggaattcctttctgaaagcccctcaattttcacattttcaagaggacatcatcttctctaaaaaatacaatgatgaggtcgatgtagtggcctccagaatgtttttggtggccaagaccatggaaacaaacagagaagaactctatgatctcttggaaaccctgaggagactttctgtcacctccaaggtgaagttcatcgtcttcaatccgtcctttgtatacatggatcgatatgcctcctctctgggagcccccctgcacaactcctgcatcagtgctttgttcctgctcttcttctcggcattcctggtggcagattcactgattaacgtctggatcactctcacagttgtgtccgtggagtttggagtgataggtttcatgacattatggaaagtagaactggactgcatttctgtgctatgcttaatttatggaattaattacacaattgacaattgtgctccaatgttatccacatttgttctgggcaaggatttcacaagaactaaatgggtaaaaaatgccctggaagtgcatggggtagctattttacagagttacctctgctatattgttggtctgattcctcttgcagctgtgccttcaaatctgacctgtacactgttcaggtgcttgtttttaatagcatttgtcaccttctttcactgctttgccattttacctgtgatactgactttcctgccaccctctaagaaaaaaaggaaagagaagaaaaatcctgagaaccgggaggaaattgagtgtgtagaaatggtagatatcgatagtacccgtgtggttgaccaaattacaacagtgtgataatgtctgcttggcatattttcaccttaggtcttatcaagaccaaagagattatgttaatgaaacaattaaattcaaagttcttcccttttttaaagataggaaacaggcattgccaaaaaaaaaaaaaaaaaaaaaaggaaaggacagtggggagaaatgggcctggcatattttcagtctttaaaacaaaggagttgttatgagaattcacacacacatagacacacacacacacacacacacacacacacacacacacacaccctgggagacctatagtctcttaaactaagatcaagtagaagaaagcttattaacaagcaggatcctgccttatccaaactgcagatgttgctggcattgtgacaaaacccactgattgaaaggtcaactgccaaggcagaaacacctttaagcattgttcaaacaataaggcttccagaacttctgtagagcagtagctccagtcatggtctgtggtttgaggttttagctgtctcacctagctccctaacactgaaggagatacttgtgaaagttctgaccagcaaaagcaagccagagccttggaaactgatatgtggtagagtggccatcactcatggactaaaattgattcaccgctaaatttacccaggtgaagcagtttcgttgtctagaatgaaattatcatattccgccattggtatgcctttaacatttgtatagtttggtttgcttaaaacaccttaaaaccaatgacagctccagcactgcagaattggtgtgattctactttggaatagcttgtcacttgtcaccaaatgggtctgctttattagttacagctcttggcaggaggatccagggacccaaaaccacagggccaaacccaaatacctggcatgatggagcaaaagcaggtgtctacttggacccagatatagtgtctccattttaacaacaacaacaaaatagccagctggtacagctgtttgcattggccctacatgcattttttgcatggatatccagaaacatctgcccacacaaaactgcggggaaaaaaaatgaacactgaaatagttatttgctgttgcttccaacttgtagtgccagtctgcctttgctgtgaaacacacctgctcagagacagagaggggaagaagatctttggtaagtctaagtcctgacgctgagaagctttgtaaaagtgcagggagataaagggccaaaagggagatagatggaaaacactggaaaaagtattcactgatacaaatctatcaatgatggcagtccaattctcttgctaaagtggctgcacctcaccttgctggtcccccccacaccttttttgatgtccttctgcgtcatcatagcaaggcccttctgtaaattaacaagcctagatatttatactcttgacttccagtatctacagaagaatggttcatagatctaaacagaaatggtttagatctaaaaaggctgtatacgttgcccaggcccctgcatttctttaaatttataaaaatgaagctaaaacctggttacatttgaagcaaatatctacagtatttttcccttttagagatgtagcttccttagacatctgtagtggtaagcatttcccaaaagcatcttacctttctgaaccttagcagacatactgtgcagcttacctatcttctgcagaggaggaaactgagacctaggagaataaagtgactcactcaggtcacaccactaaagggttttcatcatttcagcatacctaagacagggcagtccaattttcagtattctcataagatggctattactcctctcaaaatgcatttccaaagtaggaacataggacttcgttggccacagggcagacatttttttagtgtctggaattaaaatgtttgaggtttaggtttgccattgtctttccaaaaggccaaataattcagatgtaaccacaccaagtgcaaacctgtgctttctatttcacgtactgttgtccatacagttctaaatacatgtgcaggggattgtagctaatgcattacacagtcgttcagtcttctctgcagacacactaagtgatcataccaacgtgttatacactcaactagaagataataagctttaatctgagggcaagtacagtcctgacaaaagggcaagtttgcataatagatcttcgatcaattctctctccaaggggcccgcaactaggctattattcataaaacacaactgaagaggggattggttttactgttaaatcatgtgttgctaaatcattttctgaacagtgtgttctaaatcagtcattgatttagtgtcagccacgtggagcacctcggcttaaagcagctccacaaaacctgacacaacacacacaccaattaaatggattttgttgagaatttaatcattcaatttggtcaaccagaatgacttcctgtggaactctgttttatgacagataatagttttccaacttgattgagtctctgtataccctgggatattgtattttttaatgaagggcattttcaaacttgtcaacttctcttttcagcacttgaaatgaaggcttatggaattctgactgtgaaatgaatttttctattgggagattatgcatgccaagatttattatttattgttagataattattatttatttgttaatactgattattgattattgctctgctgcattggtttagccccgctatggagaagacactttagaagtaactcagaatcacatccccataaaatctaagtctttacttcatcaagttttactttttgaattgctataaagacggaaaaattgatccctgcaaacacttgaagaagctgtgttttttttctttcaattaattccaaccaagacattaacgtccactttaccaaagaaacttacttggttggtttttagttggtgtttgttgtttgtttaccaaagaaaatattcgattcatcaaaaatattgctcctggtcaactaaaaaactgtgatactgggacttttttggccattcataaggaaaatttttaaaagtcaaggtaagggtgatattctctcatttagtggaagaagaagatgtcaattcacagggaatgtggtgttcgcaagaaagaaaatgatacttgaaatagggcattattgtttagcctacagcaacatttcaacaagcagcatcagggctcctcaggttaaaagaagtacagtttgtttcagagaaaaaggaagacaaaccctcgtgaaatgtttctccattgttccagctcataagttttactttgttttgggttttggagtttttagtttctttgatgtttgttttgctttaatttggtttgtggtttgtgtttgcttgtgtttgcttctgcctttcctaccttctgccttttactccctcagttttcagtcagaagtgtgataatcagatgccatcctccatggccacgcttatgtatgcaatataccgctccaaatgaggaccttggtaacccttgaccctttaattctaactaaccatcacccaatcgtaagtggcattatgggaccatgataccacttttctccagtgtcaatgacagagctcagctgtgtccatcacaagaaaaggtggaatgggcagctgtcttgggggtgtggcaagaggcagaacctcttggacacaaatgttatcttcctcataatggctttattcttttggatcctattaaagtacccctgtagcttatagtagtgtttgacctctgtgactctgttttctcatctgtaaaatggggataatatcagtaaatgtctttaaattcagcaaatacttatcgagtgccaaatatcgcccagatactgttcgagaggctggggacacaacagtcaacaaatcagattttttaaaatctgctcttgtagagtctacctttgagtgacattgcaggtatattgtggggattgaatgagatgagagatgacatttggaaagcactcttggaaaggcctggcaaagaaaagagactcaagacattatttgtaattcagcaatctcgcacagtagcattagggctcgggatgtaaagctactgagaagtagatttgagcctgagaattagggctacaaatacaatgagttgccacagaaggtagttaattaccagtcattttaggacatcaaaatgaagctgatcaccacatagtggggccactgtaaaggggctgcaagtcctggatgttggcatcatactatgatctttgaaaaaaacagatacaggcacttgcttttggggatggggaagggacaccactgattactgaataactgtggctggcttgtctgagggaatgtaaacattcccttgaggtaatttgcttttaattttgtgtaaaaagcaccaggtatttagagacataaagttcccgttttttaaaagaatagtaaatctgcaatacaaagaaaaatattaagttagtggattcgctggcaaagaactaagaatggctgcagccaacacactgcagagttcctccctgtggtggttacaactgttatttctgtttcatgccagtccaggagaaagcaaagaggaaagtggatgagctataatccgttcacctgaataggcagtgccaggatgtcccccccagcttgcctctcacccgccccgctgctgcccagctgatttgtttgaagtcctctttgatatctatgagagcaccgtggaaggaagaagaagggaggcgaccggagagctatggcctctgtgcagatttttgagttagattaaaattagtaccacctgattaggagcctacctggtgaggaaaaaagccttcttttcaaagtacaaaaaaaagcgatgtgtaccaaggagaaaaccagcagagaaagcttggtggaagaagtgatgttcttgtggaatgtgccagcagcttctccttccagaatgctgacaccagatgaatctttggttagaattaagcctacccctttgtttttcacatgagaaaactgaaccctcgagtaatgaaattatattcacagagctaattagaaacaggagactataattgaaatctagtttttagcctcaattctttctccattttgccactttactgccaaattctattcatctaaattattggggtcttaacctgggggccaaatgagttcatgggaggggtctctgagtttcctacaattaagttacatgcaaaaatgtgtgtatatgttcaacatgtgcattttcctaaactgagggctcagattccaaaagaggtctatgaccgaaaaagggtgaagaaccactgtcctaaattaatacagacctcattgggagtgtgatcctggtgtcctcattttggctaatgagcaatcaagaacttttgaactatcttttctctaaggatccaaaaatgcttcaaaatattggtttcttcatcccaagccaagtgcctacttctattcatttattcttcattcattctttcattcattcatttctttattctgcaaatgtattttcagtgccaattcatgttctagcagcagctaaatatgccctccacagcaggaccaggaaaggagccctctgtactgtgctcttgttggcaagaggaacaccaggttgctaccacattctcactgttgcaacaaattatatatagcctcaaattttcagtaaccatcccacacacacatacacacataaaggcagcagccaacaaagccaacatatagaagtgtgccctgtcaaagaaccaggaagagcagcctatttccaggttatatacagtgatatgctgtttacaactgcataccacatccttagaaggcctgctcccaaatgagccctactctgagatgtctacaccaggcatgctttcacacacgtgcagtaccctactctcaaaacaagtatggagagaataagtctcattcatctcgttaatatttttagtgggcaaagaagcaaccgtggccatggacagatgggtgcatttaaggacaggtgtggccgggcacagtggctcaagcctgtaatcccagcactttgggaggcggaggcgggcagatcacgaggttaagagattgagaccatcctggccagcatggtgaaaccccgcctctactaaaaaatacaaaaaaattagctgggcgtggtggcacgtgcctgtagtcccagctactcaggaggcaggagaatcccttgaacccgggaggtagaagttgcagtgagccgagatttcaccactgccctccagactggcaacagagtgagacttcgtctcaaaaaaataaaggacaagtgtgttttatacacaaatatgcagaagcccagttctcttgactccaagtcagaagctagataaaatagaggttgctgggggaagttggaaaataaatgactatactgtacttgttggctctgctgctgctgatataacttcaggcacaacggaagccgcctcggttggcctatgggaagggctgggtgaatcactgcttggccttgcatgaagcacaaaggacacaccaatggctgatcagtggcccttccatcatcttctgcccagccatgataaggaaagccttctattgagatggaggaatattagctcaactttgtagcatctgatgtaaagtttgaggggtttgtcttttttgtttgtttgtttgtttttttttgagatggagtctcactctgtcacccaggctggagtgcagtggcgccatctcagctcactgcaagctccacctcccaggttcacgacattctcctgcctcagcctcctgagtagctgggactacaggtgcccgccaccgcgcccggctaattgtgtgtgtgtgtgtgtgtgtgtgtgtgtgtgtgtttagtagagatggggtttcaccgtgttacccatgatagtctcgatctcctaacctcgtgatccacccgcctcggcctcccaaagtgctgggattacaggcgtgagccaccgtgcccggcaagggctttgttcattaggatcaacaaagtgctttgtctaattcctgcaaaatggcaaagacccagcccatttccattactcattccaggctcatgctcaggaaaactaataacgttctctttgacaaaacaatttccttaattttctaggatgaatcttgaacatgtttagctcagcctttcagatatttattctttaaattaccatcctgtcaaaattgcctttacgcactgatccagaatcaccaaggcagttgccacgatgcctcccaggactgtgggtgactgggcaaactggtaatgacccgttggctctgcttcacacacacacatacacattgacacacataaatgtacacatgcatatatgtgtgtacaacacaactataaaacatagaaacatatacctgtacatatgcacatgcttacatacacacatatcacagatgtgcatgcacacatacacatgcacaccaccttttacaatatgcctgacacatttgaggcacattaaaatgccttggcaggcccagccctatagttctgtaaggtttggcaggccaaaggcttcggatgtctgcaggataccattgaaaaaatgttatcttccccttctatatgtttcttatgcacgagcacagctaagagcagccaaatagtaagctttaaagaaaagaaacctggaaaagtgaatgtgccttgcaatttaaaaattgctaacagtttcacagtgggaaaattgcatttgttggaattttccaagtcataagcaagaagaatagcatagacccaaaacgacagagatctcttccaaggtatggaattgtggaaatttatttagaatatttgcttggtgatccagagaagggggaaagaagtggtgaggaagaatatatggggtgatccctccaaattgccaactcctcgtcttaggaagaagtgggcagtttccattgatccctagcatcagtttgacgggaaaaccggtgcatttcatcaacctcaaggaaaggaagtgccatgcatggaggcctggtgataggcaacatccatttagaagaacagtcacacaagcaacagaagaactatccaagactagaagcttagaagcttataccaaactctctgtctctctctctctctctcacacacacacacacagagtggatgggaggggacattaagaggaaccctagtgcagttcccccaaaaaaccttggcatagagtataacagggaaaaagtaattactgggaagctgaaaacaatcaaatatgtgaggaatgactgaatatgagctgaggataatgtaaattgttctggattgtctataagataaagatacagagcctgaatctatgtttttctgaataaagagaccccatattctcttttgaattattgacctataattcctcttcagcagctttgaatacactcaagttctcttcctattgtttatgatcccataatacaaccacccactatttgttgtggtttacaatccagcttagaacccttgagcaaaattattgaattattgaatgctaggcccaaacaaaagaaatttcagcttggttttagtaatttcttgatcaaacttctctcattcctctaaatgtacaaaggtttcaaagttgtaaaaaatatgtctacatagccaatgctcttagtatttttaacagcaaagataatctctgccaataattattaatgacaaaatagtgataactgttcaatgttgctttaacagtccaattgtagtaggtgagaaaacaaaaaagaagagaagctatgttgaatatttagtaatgttggaaaagatcctcaccctagacataaaatagtttaaacatttaaacatggcccctctcttattgtcattgctagtgaaagaagttcctgaaattgcatattacattgtaaagttttgggctaaatcacaatacatttttaagttgcttccatggcaatagatcgtaagaccacagcttgtcaaagtaaccactaattcagtattcagaaaccttatcatctgttcctccaaaaagaccccatagttaatgttgtgtttcccagtattttagttgggtttcttcacacttaggcaagtgggtgattctggtcataataaactattttcaaactaggaaaaagtatccaaatgctagagcacataatgagttcagcttggtcagttttgagacagataagcataaaaccctactagaaaaaaataatagtcaaacctaaagctttaaaaaatgtgagtcacatcacttttctccaggaaaggcagaacgtgctcagggtggaatttaatcaaaaatgtacccagaacaatttcccacaaagagctgtaatactttgcagcaaggggcattaataaactctaatttttaccgaaagtcaagagacacacagatcttttttggtaccctctacatcatcatagcaaggcccttctgaacattaacaagcctagatgtttctactgcttatttgcagtatctacaggggaatggttcgtggatataaacagaaatgttttatctgaagaggctgtgtatgccaccccagacccctgcatttcttaatatctataaaaatatgactaaacttgttacatttgaggcaaatatgtacagtatttttcccttttaaagatagtttaaaaaatcaaggtaataaaaaacggccaactctttcaggaaaaaaaaaatccggtattttgtactacttgagtttctctaatgcctaaaatatgcatttaaatcatcccacacctacacagaaacaaaatcagcagggaaaaccatcccactgatgattggcaattccaccgttcctctccatctgaccagctttcaccagagggcgatctttcatgcttgcacatcgagtttatacaatgtagaagcccccaagtcacctgggaaatggctcatgccaaatacatggagtccttagttgactatcttttcatattaaaatcccatcttccaatgaagcatcctgttttcaatactgatatcaaatttcgaatgtaaaggagatttcaaatgtattgctttcaccttttcttttttattcatttatttttaattgacataaaaattgtatatatttatgggatacaatgtgatgttttgatatatgtatgcattgtggaatgattaaatcaagctaattaacatatctatcatctcacatatttctctttttgctttcactttttcgggtttatttctaatcctctactaagcacacaacaaagagtcaaatgtcggtgggccaggggaatatctccagtttgatttttttgggggggggggacagagtctcactctgtcacccaggctggggtgcaatggcgtgatcttggctcactgcaacctctgtctcctgggttcaagcgattctcctgcctcagcctcccaagcagctggatttacagatgtgcaccacgcccagctaattttgtattgttagtagagacggggtttcaccatgttgaccaggctggttttgaactcctgacctcaagtgattcacccgcctcggtctcccaaagtgctgggattacaggtatgagccaccgcgcctggccttttctttcttttttatgtccaggtatttcatttctctttaagagtaattagtatgggttcttcagtgttgtttatgttttgttttgtttataccagattagcaatcaaaaaaaaagtgtatatgactcaatatcctacaggcagaggtttggggttttttttgtgtttgcttgcttgtgtatttctttagcagcagatgtctttttataaaaccttgtatatggtgccttctttggcttaacagtcacaatggtacacctctgtctctgaagtaagaaaagaaaaaccagttcctggccttagtttaatatataatcacaaatggggaaataaaattgtagtgggaagcaccctatatgcctgcatgcctgggcttacaagaagtcagcagaagcctaataaaaaatataagcttggcctcttctttctgtagaattctggttttccctgggtatttagggttgggaagaggaaatgttgggtgtattagttataggtcatcacctgtatggagagaaaggggagaaacctaggaggaaagtaacaaagcagtatatatacatggggtgtcaaaacaattgtcgggagttgctaggttagtgttcttttttagttcatttcacaggactaaataaatggatgagtgattatcactgtcacaaaagaaagtttgaatctaaaattatatgttacaggtaccaaattacaatatcataatgtaaagaactgggattatttcagattttgtttcaatagtgctgagctggaacccagcagctgggaacagctaaaggagaagtagcactcactcctgtctgctaaagtccttatttagcccatttccatggaaactgaaatcagatctctctctctctctctaacacacacacacacacacacacacacacacacacacacacacacacacacgctggcgggtgaatgtctagagtgtgtgtgtgtgtgtgtgtgtgtgtgtgtgtgtgtgtgtaaacatacacaggataatttctccgtgaacattctctcatcagaggtaactctccaacaaatggaagaagggtcagcaatccaggctgacttccttttttagaagccaaacctgtaatgcagatgaaaaaatcgggttagaaaagtaaatatatcacaccaggcctttgctaccaattccttggggcattccatttcgtaactgcatattcaattaatttagctaacttggaaatattttatggtgagcagacagccactgaaactaaatttaatcccttggatttttgcccactttgctttactctgaagcattgacatttccctatatagcccggaaaataaaggctaagggaaaagagaaagtgaatgaatttattttaatttttcaacatatactttgttaagtttctatcctaatggaaaaatgataggtgcatattccagatttctggggacattttataataaatgattccatcttagtccacatctcccttgaagacaggccaacgctcaagttgctgcctataaaagggtactgataaaacctccccataagggtggaagaagaatgaatactgttcctttcaatgaggtcaccaggcaacctggatgacttctatacatggaaaattttcgataggcgaaaatattttacttcccatttctgtcctttttttctatgaggaaagataaaaataggatttctttttaaagaattttcactttaaaatggactgtagatgatgattttggatcttaaattaggttattttaccatcccctttgcaaaattggtgagtgttgcagctcataaaatatttagcttttgctggaatctaaaatgggatgaaaagctgtatgtttcagctggcatagatcaacaggacaatagggcttgatcttaaacataagtggcttattttattttattttagagacagaatttcgttctgttgcccaggctggggtgcagtggtgcagtcatgtagcctcgaactcttgggcttaagcaatcatcttgcctcagcctcctgagtgactaggactatgggcacacacccccatgcctggctaatttcttttttaatttcttgtagagatgggagtgtccctatgtttcccaggctagcctcaagttcctggcctcaagatgatcctcctgcctcagcctcccaaagttctggaattacaggtgtgagccaccacacacagcccataggagatatttaaaaaaaaaaaaacctcaatatagcatattctcatttgtgcctcatacttgaataggcagacttgtgaaagaatgagggtgttgatagtctatattcaaaactagggtgggggaagcaattgttatattttataaaatttaaatatttttagaattagaaaattgacgaagggctaaagtctattcaaaaccaccatggggagcaatgattttactttataaaatggaagagtcatttcttagaataaaaaataattaacagtaaagagtgagaggtgagaaaactaacatttcttatactaaggcatggctcaagatgccagaccctgccctcttggaggcaagtgctatctcccccgaggtgttacactgagatgacatttcatcatctacatgaaaatcttcatttctgcagagagcatcactgactcacagaaaataaacacaaaaacagaaacaaaaaaccttgagtcacagtacctaagccaagttcaaaaacatccattgggagagacccccaaaagaatgtataataagtacccatcactatagcttgaacaggaatacagatgttgaatctgtaagaatagagtcctagaagccatcaagtaaaggatcccaggctgtcatatttgtctgcatttatatgaattaaaaaatgtatggttgttagaaaaaggggcccacttaatttttcgcttgaccttgcattatagaagaattatagaatgaccaaaaaaaaaaccccaaaaccaggaagtagtactaaatatgtttaacagaccttggcaattgatgttccatggctaaaaggtaaattttagaatgatctagtactactaaataatttctgtatatatacacactgagtccaaagcttaaacttgaaataactatagttgtgagatttgtatcccagcatttcttttgtaggtgtgaaaagaaaatctggaaattcagcaatgtcattaaatacaaattcacagtaggactttactttcaatccttctagggtctgggcatttcctttccattactaaagaaattggaaatcttagcaagtgaaaatatttttatcattgtattaatttgaatgttttttctctctctaaaagtgttctccctcctcccttattcttttactgtttcagaatactcaaaaaacaatccatagacttcagctagtatggctcaaatgtttcccaaacttttgcgattgtaaggattcctgggttccgctaaagggtggctgatgcggcttccagattaactctttcctaaaagttatagaattacgtatcaacagctaaaggacacaattacaagctgaaatactgtcacatactgtgtaatatcctacaatcttgcagtgtttaataaacagacacctctgtcatttcatatttatacagattttaaaattaagcacacaactaaaaacaactacgtatgtacccctattgcattacttggatcatggcaaagggaaaacacaacaaacactactgcaaaacgtttggccatcacacagcattaaaaataaagcagatgccgagttgaacatttactagtgtgtgatgtgccagcctagaatcttctaattcaggtgttataactcaagcatttttcagaatttggttcatacatgtcttacaatctgttattgacataatgatgagggagatgagtgtctcagaatgggtctcccccagaatcagactaggagacaatatgtgcatgtaagtggtttgtttaggaggtaatcccaggaataccagcaggggagaggcaaagtgatacagggactggggagaagacaacaggggatatattaatgaacaggttacctctatgggcagctggagcccaatcccattggagacttctgggagatggttatggaacatacttcagagttctatctgggtaatctggggtatttaacttccacttccatcaaatattggataaaggttccttattaactcaccattattaactcctcattaacttgccagcacctacagcctgccccatctgtgacctgaagaagaggcctcaaggagagagctacaggtgtctgcagtagatgctcttggcatatagtaaaatagtaagtgttaaaggatatggacagagcaccagcagtctggtacaatgaggcatattttatatacatgtatgcatatatatatatatgcagacactgaacagattctttagctctctgagacaccacgaggttggctctgcagggatctaagccaagactaaaggcaggtaagctaaggtctaggtaagggctccagcagaataagaccaccaagggaaaagtaaaagctggttaacaatactgaaaaactaaggccataggcatagtagatgcagataaagatcatagctcacgaggtactctggaagctacgtcattctaaggtatgaacaggattaagaaaacagatgactggagaaaaactggggtatagtgtcagcaccaagaagagctctaattctagtttatctttgtttgtaccagaggcttcatatccaattgtgtgctgataaactttaacaactggctgccaggggaagaggggtggcatggcctataccaagctactcatggtttaataattggcttgcaaaactcctgaaaatgtaacaattggttctcacaaattggaatgagccagcttcagcatgccattgcctgtatctctccacccaacatccagccacttttgaagggctattgactacaactaaaacatatccagttcctggtgttgaaagttgtgcctgtaactacctcagtacatgtgtgggtgggtaacaccattgatttgggtcttggggatatttagtggaggctgaactcttgaaaacctctgactctccctcattcttgtcttcctcggagccttcgacattccttgagtctggaattaggattttggaagaagtgcttctaggtcagattctggcagtcctttaccacctgcagatcggcatctataatgtgtcttatccatgccatatctattccaatggcttatgcactaacatttgctccatgtatttatagataaaatcaaattacactcatatccaaaagcaaaagaacctagaactgtcataagtacttcagttaatgaacacatcacagcacagtcatatactcaactctcttccagatatcatagttaatgcagattacggctgcccaagccatgaacgaaatgttacacatgaaaacaacagaaacgcatgttcagttcatacactgggcttcctctccacccagagttcagggaaacctgtatctcccccattaaatcttaacaaacagacgtaattgtcaaccatagctacaagaagccacccctcgtctgcaagcaagctactcaccattagtcggcatttcccatgaccttcatatttttaaatattaagtgctacacttctataatctccctgatagccacatgagttctactccggattcatgctgaattgtgttccattctcttgattgtttcttctgtgttcagaaagaatagtagatccattttcaaagtaaaatatccccctttccctgtcttcctctggtcatacataaagaagttagtaagacatcgctcatgtactctttgaatttcctttcacttccatgaaacttccccacaacttgctggccctcttcactgcgaaggtggcaaatttgagttgggttcttctgcgtctatgttttatgaaaagaagtccttaattatgtcaattatagaattagagtaaaaatgagtataagtttccaattatttggacacgctactctggaagttcttgtattcagaaggcatctcaaggaaagtctggagaagaagaaactatttgtggcttaaaacttgttctctttatagggcttctctttgtggtagctaccccttggctcggatcaaggctatgattttaaactcctttgttcaattttgcactgtcatctgaagactagtagcagaaagtagcaatttgaataacaacagtctttcaatgtagttctaatatttcttcaagagatatccaaatagaagcatttctttaatattccctgacaggttttcctttgaagaagttgtaatctacacaatattttattttctactatagcacatcccatccttctgtccacagcagccagatggtacttcttattagctgaagaaataatcagacaagaaaaactggccattgaacaattaggaatactacttgatatatttttcccaggtatccattcttggttctcagtaacaagaatgtgccagctttcaacaacaaatgctggcaaggatgtagagaaaagggaagagggaatccttgtatgctgttggtggtaatgtaaattactacagccactatggagaacagtttagaggttcctcaaaaaactaaaaattgagctaccatatgatccagcaatcccactcctgggtatataccgaaaagagaggaaatcagtatatcaaagagatctatgcactcctatgtttgttgcagcactatttacactaattaagatttgcaaaaaaaaagatttgcatgcatgtgcatcaacagatcaatggataaagaagatgtggtacatacacacaaatggagtactattcggccttaaaaaagaatgagatccagtcatttgcaacaacatggatggaactggagatcattattctaagtgaaataagccaggcacagaaagacaaacatcgtatgttctcacttatctgtgggatctaaaaatcaaaacaattgaactcatggacatagagaatagaaggatggttaccagaggcagagatgggtagtgggagggtggcgggggaggtggggtggttaatggatacaaaataagaatattttaaaagaatgaataagacctactattggacagcacaacaaggtaactatagtcaataataattcaattaagtattttaaaataccttaaagagaataattggattgtttgtaactcaaaaaataaatgtttgaggggatagaaaccccattttccaaaatgtgcttatttcacattgcatgcctgtattaaaacatctcatgtaccccataaatatatacacctactatgtaccataaaaattaaaatttttttaaagtaccagctttaacatttcccagcatcataagtcccaacacaatatttctaatcgctcagcttcatctcaaaatggaagagtgccagggacaatgataggatttaagatggcagcctgccactgcgaaattaccacgagaggccgggcgctgtggctcacgcctgtaatcccagcactttgggaggccgaagcgggcggatcacgaggtcaggagttggagaccagtctgaccaacgtggtaaaaccccgtctctactaaaaatacaaaaattagccgggcatggtggcgcacgcctgtaatcctagctaatcaggaggctgaggcaggagaatcacttgaacccgggaggtggaggttgcggtgagccgagatggtgccgctacactccagcctcgggaacagagcgagactccatctcaaagaaagaaaaaaaaagaaagaaagaaattaccatgagattagagtacctgaaccggcaagaggtagatgagataggagatgggggtgagaaggggaagaatggagtgcctaatctgtatctgagtagacttcatttatttagcacagtatttttttcataaggtgcttggctgtttgaaactgtcatttctagctatcctagaacttgtcaatggtagggagtatacctctttctttaaaaatcatattataaaaagatgcctaaatgtactttttttctgttgtaaccctaatttatattatcattccagaaagtttttcttaatttcaaactaatttttgataaattagatttaggtttaaattgttctgctcgccaatctttgactaatgattgtcaaagtccttctatttcaaagaatcccttggtcgaatggtatcacaacatatctcactgtgaaagagaggattaaggaacaaggttatttcctcaactggcaaaaaaagattgttgatttgattataacttttatatgctgaattgatctgtgtgaaaaatggtatttctggcactgtgatcctctataaggaacaaacttgattattaactgtggcacacaaatcatgatgttctgttactatcgattatcaattattcatttccttgtaaccattttcccttcaaatattccaaccgcttacataaaagtcacctaaattttcctcaagtcacctgccaaggaaaacagaggatattcagaacatatgagacaggtgaggaaagtggtgggaaatcaggtgggatttaaatatttcccctgcccatactgacctctaattcactaccaaaataagttgctttaggtgatgaaaagtgggaagtaattctataaagacaaagacattttaatatctcatagaaaaggatatttgtaaatggttgcaactacttggaaatgactcaagttttagctcatttaatagcagtaatgttatcttttatgtatgtcctcatttttggtacatttgtatgtaactattgggtataacataagaaatcaaaatcagtaaattagagactaggcatggtggctcatgcctgtaattctagtactttgggagactgaagcaggcagatcacatgagctcaggagttcgagaccagcttgggcaacatggtgaaaccctgtctctactaaaaatacaaaaattagccaggcatagtggtgcatgcctgtaatcctagctactcgggaggctgagacatgagaattgcttgaacctgggaggcggtggttgcagtgagccgacatcatgccattgcactctagcctgggcaacagagcgagactctgtctccaaaataaataaataaattagaacaaacaaatcattaaggcttttatttaaatcttgtattaatgctttctctgttttgtttcataaatggtttctcttacagacaagaaaatttattaaaacttcaaatcacacaggattttgatggatgccgtatgtattaaaagtctttaaattgttgcttacttctaaccggatgattctgtgaaagagatcacattcattgcagctttaactggatggcctactatagagtctgttatagaaacagatattaagtagattatttttaaaggcaagtatactcagatcaactgttgaccctacataggatgggcatgaattgtaatgggacccatgatggggccaagaaattatgaagagtaacatgggacccccttcctcaagagaaatacctctcaatcatcttactggcaagtatgtaccatcagcttcctttatgaatgaacaatgtgttatttgttcttgattacgtaaagtgaaagttccttgacatgtactcattctggaataataagtatatggtataagtaacactgaaagatacagaggtcaatgcagcttagaaagaaactgaagagggcaagggagtgtcaaaacattttggaggcaactgcagcaataataaaggcttaatttgtgctgcctgcccttcctgtgctctatggcactgtttccagtgtcctgcaaaaggccatcacccataatcccaaagatccactcttcaataaaaggcccaaagactcaagatctgatgaactgtgaaaatatgacctttttatgacactagcaaatttaccaagaagggagtggaagaagtatacatgctttctcagtagtataacattgcttttactcaattggatatgacagtcattaagtacctgctcaatatcatgcagctatggcagaaactcatcttactgagggacttgtaaatagactgaaaaagaagataggcatatcaatactagcatccaagagactcctataagtcggcaatgccttctacctatctctgaattccacgacctccaaaaggtctcatctgctaatttgaaaacatgatgaaaactgtcttcatttaaccaccccactcaaatgccatttctattcactgtatttttagggtcaattaggttgtaagtaacagaaaagccaactcaaaatagcttaaacgataaaatgccaatgtaatttgaaagttaagggttagggcagacaggttttagggtagatttgattcagtagctcaacaatgaaacagaaggcccagattcgttcctccatgagacaactttatcctcaggatgtttcccctttctagtctgaagacagttccagtggctcctagagatacatactcttcaagggagggagagaatcaatctagctttaagatcctagaagcttctttcccaggagttgctagtattactatgatatcacaaatccatccatgaaccaatatgtatggtcaaggaatgggattaccctcagaatctcgggcctaagaaagagatctcacttctagagccacgggtgggatcagttttcccaaaagcaattgaaggaatggaatcaaaacctcaaggttgaagaaaagctgcacagaaatacacttgtgattactaggctggagaaagaagacctcagaggagaaatttttccctacaaggggaagccaccatccacactccatcctttctcattgctgttatggcaccataaggctgggtgttgtgcattctgaaagagaaggaatacgtgagggcatgacacttacgggcctgaagtcagaaatctttctttccttttcaacaaaatgagccactttttaagctgaacaattttagccaatggagatccacaggctagacagtgtcatttgtcaggagctgtagccataacagggctaagatcaacacatccatcacatcagacaattctacacgctggttatttggggaacatgagcacacaagaaaagagctgcccaacagaatggctgtcaaaggactcaagaactgtttacaacatagccaaggatagaggagaatacccttgaaacataactcccaaaatgcatgacttacctgagaacaatcacttccatttgtggccatcacgtattctctacctccttgccatccccacctcttcctgctccttggacttcacctctcaacagcaagatcacaagagcacgcagatcaacagagcaggcattattcttctatctcttcttctatctatcatccttctatctatctagtcctctctaatcatgcacggcaactgctttagacactttaattcttgtacttatttttaaagcaaaaactgggggatctataggtggcccattttaccaaaagattaggtgattgaggagcaagttataagaatatctcattggcaagaagggcgaagcccctcttgtggtttctgccacttactgtcatttctccagtgtccacaggccttgcttctgagacacttcccactgaaaggagttaagtcagctggtcctgagtatgcaagccataatttatgcccgtatttctatgtcctagccctagaaaaatgactcaaatgggctgtcctagagtactgagtgggtcaccaacaatatctctctacatggaggccagtatgttacaaagccataagattccttcttttaggggatttttttctacggtttttttttgtgtgtgcatcactccatatcctcacttgcctttcacatttcataaatggaagaatttgtggtcagaatagttatttgccatcagcaaagtttaataacactcagttaatttctaggaaataataggcttcattaaatgctgaagtccgccagacccttcacctcttcaatagacgtatgcttggcagctgatgggttggttttgttttgctgggattgtgacaggctgccctgacattacgtattccaccaaaggagtgaaagctaattcaagaatgatctgtaccatgatagttcaatatgctaggtatttacttaattccattcagaattatttatcatttccgagaaaagattttatattatgaactataattctacagttttcaattaagtgtggatttaaagagaaaaagaagtacagtcatatatatgggtacaattagccttaaaatcataaaattcatctggccaatattgaagacagtgactctcagacttatgaagttttggcctccttttatttgtttagtttccaatggttccatattctgccccagaatgtcatagttttaaaaactacattaaaacttattttgttttgaggggcttattttttagaattccatgacatccttcaagggtactgaaagacagcccagttgtctttcagttgtgaaaaaatataaagtgaagaataagtgattcagggcttcaaaaattaaacagtacaaattgtaacttagccaacatttttgttgttgttcatttgttgttattgttttcttagagcagaatctccttctgtcgcccaggctggagtgcagtggtgtaatcatagctcactgtaaccccaaactactgggctcaaatgaccctcctgcctcagtctcctgagtagctgggactacaagcatgtgccaccatgcccagctaatttttttttttattttttctagagacaggggtttcactatgttgcccacgctggcttcaaactcctggtctcaaatgatcctcctgtctcggcctcccaaaacactggcattacaggcatgagaaactgtgcctagacttaagccaaccttttaaaatttctatgcctaaaagtagagtttacctcttttttaaagcagtttgttacaagtcattcagaatttgacaagactctagtgagctgggcttctcaaactctggcataagaattacctggagggtttcttaaaacaaagatagtgggcctcagctccagagattctaaataaatagttctagggtgcagcctcagaatgtgcatctctatctagctcccagttgatgctgatgctgccaaggcccagatcacagactgtaggggttttttcacaaatctgaggtttatgttatgaagaaagataaacattcaaactccttactgtttcttcatgcagtataaggaccaaaaaatcaacctcaatatttgatcttattgtcatgaaagctatagggatgcttctggagacaatatccacatccactgaggatttggaaacaataacaaaattaaaatcacgtttcagaatcagccacttaggttaattccacagccccagggagcaactgaacattcaattctggttgatttgactacccattttgctgcctccaattcacaaatacctattctttaatttagggcaggaaattctgtgtacataagaatattacttgggaatgtagatggtctctagaaataagtaaacctagacaataatgcaagcaatgtgaatccaggctgaagagtgaaaaaaatcaacacgctaggtgattcaatctccaagatgctaaatacacaggttgattaatttttttcttcaccaaagttttgctgaattaactaattagcagggttgggagatgatgggaaagaaaatattagcttgattaaaataagcagtagttatttttattgaaaagttagggaggaagaaaataaatatttgtcagcacctccaagtacaagccttatgtttattccctagcagttcagcacagaagttagtatatctattattatctctatttgtgtattaaaaactaaggttattttaattgataacttagggaggaaggaaataaatatttgtcagcacctcaaaacacgagcattgtgtttattccctagcagttcggccccgaagttagtatatttattattatctctatttgtatattaaaaactacagctcagaaagtgtaagtgacatccccaatatcaccacgcaacaaagctgcagatatgggtttcaataaaatcatgctctttcctctacacatgcttctcctgctgatgtagcttctcttactatttaatactaataactaacatttactgaatgctatctgagcatttgatatatagactcttcaatgcttacaaccctataagataggcactggtaacaaactatagaaatgatccctgaggaactcaaacaactcaaccacaatctcattaaaaagtgggccaacccaggtgcattggctcacgcctgtaatcacagcactttaggaagcagaggtgggagaatcacttgaggtcagtagttcgagactagcctggccaacatggtgaaaccccatctctactaaaaatacaaaataagttatatgggcgtggtagtgcatgcctgtaatcccagctacttgggaggctggcaggaggattacctgaactcgggaggaagaggttgcagtgagccaagattgcaccactgcactccagcctgggcgacagagtgagactctgcctcaaaaaaaaaagtgtaccaaggacaaaagtatacatttttttcaaaagaagacatacaaatagccagcaagcatatgggaaaaaaaaatgctcatcgacactaatcttcagagaaacgtgaatcaaaatcacaatgagatatcatcttataccagtcagaatggctattatttaaaaaagacaaaaattacaaatattgggaaggatgcaaagaaaagggaatgcttacacaccgttgaggagaatgtaaattagtacaacctctatagaataaagtttggcaatttctcagagaactaaaaatagaactaccatttgatgtagcacttccactactggctatctacaaaaaggaaaataaactattatatcaaaaagatacctgtactcatatgtttgttgctgcactattcacaatagaaaagatatggaatcaatctaagtgtccaccaaaagacaaatggataaagaaaatatggtatgtatacacaatggaatactattcagccataaaaagaatagaatcatgtcacttggagcaacatggataaagctggaggccattatcttaagtgaaacaacccatgttctcacttataagtgggagctaaataatgtgtacacatggacaaaaagtatgaaacgatagacagtggagactcagaagtatgggggaggttggggggatgaatgatgagaaattacttaatgagtacaatgtacattattccagtgattaatacactaaaaaccctgacttcaccactgcacaatataaccatgtaacaaaatcacacttatataccttgtaaatttgtacaaaaaaaagataggcactaatattatcctcaattaacagatgagaaaactgaagttctgagaagttgagtaatttgcccaaagtcacacagctaatgagtggtaggactaggatttgattctatgcagttaaaattcaagcccatgctctcaactattgtgatatcaccacactggacaacagaaaagatgcagcttgggaattatttaacaaacaaccacttatcaataatacacccatcaactaaagatttgagaattaagaggactctgagtacggcaataatagaatatagaggaggttaatcttgaaagagtttttgaagagttaagaaaaggtaagttttcaaccaggtgtaagagagttgaagaacatgacggggtgggataaggcccaaaggcagacgcgggagtttgttccattttgaggaatattaagaaggtaaggaaacatggttaaataggcaagaaaaatctaggagatttttgttcttgtcttcatcagaaaggtataacgtgaactgaaatactttattgcagcatctgaggaggaaatattttaagactactaatatagtttggatgttgtcccccataaaactcatgttgaattgtaatcctcaaagttagaggtggggcctagtgggagatgtttgggtcatgggggtagattcctcatggcttggtgctgccctcaggatagcgagtgagttctctcagttatccggttgtttaaaattatgtggaacctcctcgctactctctctcttgctcctgctttcaccatgtgatatggctgctcctgcttctccttctaccatgagttaaagcttcctgaggcctcaccagaagtcaagcagacactgctgccatgcttgtacagcctgcagaaccatgagccaatgaaacatcttttctttatcaatcgctcagactcaggtattcctttccagtaatgcaagaacagcctaatacaactaccaactctcctgaaaaaacaaaatattttgcagacattctattgagacgtagcctactcaatttctatagcgcaaagtgacctttcaatacaaacaatagtttatttggaaagtcaccaattcaacttgtctttctggagactttctttctctcttctccttgggagatacttcaatgagcctgcatatgttaagaacatgctatgttctgtatataaatcaacagaagcaaactcacactaaatattcaaagctgaaaaacaatttgtcagaaagagcatcaatcagatgtcactgtctatctttcggatctgtactttgactgtaaagagcagtgatttccgtaagtcatttttctccattgtttgtcattggttaccagtttacactgcattcctcaaatttcatttgagttatcacgggacaataatctttttgcttgtaatatttgcatcccctcacctggaatatccaccttcaggaagtgagagatttgatgaccacaatcccaaatggttggatcagaatatccaattcaataaggcagaataaaggataaaaacattatgcaatacatactggaataaaggcaggatgggtagatcagaccaaacacctaggggagacactttcgtttaaggacaaaccattaacaccagaattcagccctaccaccaggctcacttacagtccttcctccctgctaattaactcaccttgttttgtcctgcaggacataatttgtcctgccctaaagctagcttttgcccttaggaaagcacatatagccttttggctgtttggttattatagccttgtaatacattttgaagtcaggtaatgtgatgtttctactttgttctttttccttaggattgctttggctatttatttcataaaaattttataatttttctaattctgtgaaaaatgacattggtattttggtagggattgcattggatctgcagattgctttgcacggtatggtgcttttaatgatattaaatcctccaatccattagcataggtgttttccatttgtttctgtcctccacaatttatttcattagtgttttatggctttccttgtaaagctctttcaccccttggtgaaatttattcctaggtatttttttcatatttattgtagtagggattgtcttcttcatttctttctcagctaactagttattggtgtagagatatgctaccaatttttgtatgttgattttgtatcttacacctttattgaatttatgtatcaaatctagtagtatccttgggtagcagggggttttgttgttgttgttgttgttgttgttttaaattttagcaccttgaatatgtcatccatcttcttctggcccgtaaggtttctgctggaaaactccttgttagtctgctggggattcctttatgggtgactagatacttttctcttgctcattttagtgtcctcacttttgctttgactttagacagtttggcaatatgtggcttagaaaagacttttatgcctcatgtctggggatctttgggccccagaatatctgaatgtctaggtctctagctaaacctggaaaattttcatttactatttcattaagtagatcttctaaacctttctttctctctttgcccttggggacaccaataacatgaatatttggtcactttatgttgtcccaaatgtcataaaagttttgcttattcttttttatacgtttttatttttgtctaactggattatttcaaaggacctgtcttaaatttctgagattccttcttttccttgatctagtctattgttgaagctttcatgtgtattttctgtttcatttgatgcattctttagctccagaatttctgtttggttattttttaaaatgtatatctctttggtaaatttttctttcatattctgaattgtacttctgattgttctgtattggtattcagaattctcttgtatgtcactgagcttctttaaaatcagtttttaaaatacttatttttttatatgttaagttttagggtacatgtgcacaacgtgcagctttgttacatatgtatacatgtgccatgttggtgtgctacacccattaactcatcatttagcattaggtatatctcctgatgcgatccctcctccctccccccacaccacaacagtcccaggtgtgtgatgttccccttcctgtgtccatgtgttctcattgttcaattcccacctatgagtgagaacatgaggtgtttggttttttgtccttgcgatagtttgcttcgaatgatggtttccagctgcatccatgtccctactaaggacatgaactcatcattttttatggctgcatagtattccatggtgtatatgtgccacattttcttcatccagtctatcattgttggacatttgggttggttccaagtctttgctattgtgaatagtgccacaataaaaatacgtgtgcatgtgtctctatagcagcatgatttataatcctttgggtatatacccagtaatgggatggctgggtcaaatggtatatctagttctagatccctgaggagtcgccacactgacttccacaatggttgacctagtttaaagtcccaccaacagtgtaaaagtgttcctatttctccacatcctctccagcacctgttgtttcctgactttttaatgattgccattctaactggtgtgagatgttatctcattgtggttttgatttgcatttctctgatggccagtgatgatgagcattttttcatgtgttttttggcgcataaatgtcttcttttgagaagtgtctgttcatgtccttcgcccactttttgttggggttgtttttgtcttgtaaatttgtttgagttctttgtagattctggatattagccctttgtcagatgaggaggttgcagaaattttctcccgttctgtaggttgcctgttcactctgatggtggtttcttttcctgtgcagaagctctttagtttaattagatcccatttgtcaattttggcttttgttgccaatgcttttggtgttttagacaagaagaccttgcccatgcctatatcctgaatggtaatgcctaggttttcttctagggtttttatgggtttaggtctaacatgtaagtctttaatccatcttgaattaatttttgtataaggtgtaaggaagggatccagtttcagctttctacatatgaccatccagttttcccagcaccatttattaaataggcaatcctttccccattgcttgtttttgtcaggttgtcaaagatcagatagttgtagatatgctgtattatttctgaggtttctcttctgttccattggtgtatatctctgttttggtaccagtaccatgctgttttggttaccgtagccttgtggtatagtttgaagtcaggtagcgtgatgcctccagctttgctcttttggcttaggattgacttggcaaggcgggctcttttttggttccatatgaactttaaagtagtttttatccaattctgtgaagaaagtcattggtagcttgatggggatggcattgaatctataaattaccttgggcagtatggccattttcacaatattgattcttcccacccatgagcatagaatgttcttccatttgtttgtatcctcttttatttcagtgagcagtggtttgtagttctccttgaagagtccttcacatcccttctaagttggattcctaggtattttattctccttgaagcaattgtgaatgggagttcactcatgatttggctctctgtttgtctgttatggctgtataagaatgcttgtgatttttgcacattgattttgtatcctgagactttgctgaagttgcttatcagcttaggagattttgggctgagatgatggggttttctagatatacaatcatgtcatctgtaaacagggacaatttgacttccttttttcctaattgaataccctttatttccttctcctgcctgattgccctggcaagaacttccaacactatgttgaataggagtggtgagagagggcatccctgtcttgtgccgttttcaaagggaatgcttccagtttttgcccattcagtatgatattggctgtgggtttgtcatagataactcttattattttgagatatgtcccatcaatacctaatttattgagagtttttagcatgaagggttgttgaattttgtcaacggccttttctgcatctattgagataatcatgtggtttttgtctttcgttctgtttatatgctggattacgtttattgattcacatatgttgaatcaaccttgcatcccagggatgaagcccacttgttcatggtggataagctttttgatgtgttgctggattctttttgccagtattttattgaggattttgcatcaatgttcatcaaggatattggtctaaaattctctttttctattgtctctctgccaggctttggtattaggatgatgctggcctcataaaatgagttagggaggattccctctttttctattgattggaatagtttcagaaggaatggtaccagctcctccttgtacctatggtagaattcggctgtgaatccatctggtcctggactttttttggttgctaagctattacttattgcctcaatttcagagcttcccattggtctattcagagattcaacttcttcctggtttagtcttgggagagtgtatgtgtcgaagaatttatccatttcttctagattttctagtttatttgtgtagaggtgtttatagtattctctgatggtagtttctatttctgtgggatcggtggtgatatcccctttgtcattttttattgcgtctatttgattcttctctcttttcttctttattagtcttgctagcggtctatcaattttgttgatcttttcaaaaaaccagctcctggattcattgattttttgaaggggtttttgtgtctctatttccttcagttgtgctctgatcttagttatttcttgccttctgctagcttttgaatgtgtttgctcttgcttccctagttcttttaattgtgatgttagggtgtcaattttagatctttcctgctttctcttgtgggtatttagtgctataaatttccctctaaacactgctttgaatgtgtaccagagattctggaatgttgtgtctttgttctcattggtttcaaagaacatctttatttctgccttcatttcgttaggtacccagtagtcattcaggagcaggttgtcccatttccatgtagttgagtggttttgagtgagtttcttaatcctgagttctagtttgattgcactgtggtctcatagacagtttgttaaaatttctattcttttacatttgctgaggagggctttacttctaacgatgtggtcaattttggaataggtatggtgtggtgctgaaaagaatgtatatactgttgatttggggtggagagttctgtagatgtctattaggtctgcttggtgcagagctgagttcaattcctggatatccttgttaactttctgtcttgttgatctgtctaatgttgacactggggtgttaaaagtctcccattattattgtgttggagtctaagtctctttgtaggtcactaaggacttgctttatgaatctgcgtgctcctgtattgggtgcatatatatttaggatagttagttcttcttgttgaattgatccctttaccattatgtaatggccttctttgtctcttttgatctttgctggtttaaactctgttttatccaagatgaggattgcaacccgtgcctttatttgttttccatttgcttggtagatcttcctccatccctttattttgagcctatgtgtgtctctgcacgtgaaatgggtttcctgaatacagcacactgatgtgtcttgactctttatccaatatgagagtctgtgccttttaattggagcatttaacccatttacatttaaggttagtattgttatgtgtgaatttgatcctgtcattatgatgttagctggttattttgctcattagttgatgctatttcttcctagctttgatggtctttaccatttggtatgtttttgcagtggctggtaccggtttttcctttccatgtttagttcttccttcaggagctcttttagggcaggcctggtggtgacaaaatctctcagcatttgcttgtctgtaaaggattttatttctccttcactcatgaagcttagtttggctggagatgaaattctgggttgaaaattcttgtctttacgaatgttgaatattggtccccactctcttctggcttgtagagtttctgccgagagatccgctgatagtctgatgggcttccctttgtgggtaacctgacctttctctctggctgcccataacattttttccttcatttcaactttggtgaatctgacaattatgtgtcttagagctgctcttctcgaggagtatctttgtggcattctctgtatatcctgaatttgaatgttggcctgccttgctagattggggaagttctcctggataatatcctgcagagtgttttccaacttggttccattctccccgacactttcaggtacaccaattagacgttgatttggtcttttcacatagtcccatacttcttggaggctttgttcatttcttcttattcttttttctctaaacgtcccttcatgcttcatttcattcatttcgtcttccatcgctgataccctttcttccatttgatcacatcggttaatgaggcttgtgcattcatcacgtagttcttgtgccatggttttcagttccatcaggtcctttaaggacttctctgcattggttattctagttagccatttgtctaattttttttcaaagtttttaacttctttgccattagttcgaacttcctcctttagctcggagtagtttgatcttctgaagccttcctctctcatctcgtcaaagtcattctccatccagctttgttctgttgctggtgaggagatgtgttgctttggaggatgagaggtgctctgatttttagagtttccgttttttctgctccgttttttcccaatgtttgtggttttatctgcctttggtctttgatgctggtgacgtacagatgggtttttggtgtggatgtcctttctgttagttttccttctaacagtcaggaccctcacctgcaggtctgttggagtttactggaggtccactccagaccctgtttgcctgggtatcagcagcagtggctgcagaacagcggatattggtgaaccacaaatgctgctgcctgatcattcctctggaagttttgtctcagaggggtacccggctgtgtgaggtgtcagtctgcccctactgggggatgcctcccatttaggctactcgggagtcagggacccacttgaggaggcagtctgcccgttctcagatctcaagctgcatgctgggagaaccactactctcttcaaagctgtcagacagggacatttaagtctgtcttaatttaaggttattgctgtcttttgtttgtatgtgccctgcccccagaggtggagtctacagaggcaggcaggcctccttaagctgtggtgggctccagccagttcgagcttcctggccactttgtttacctactcaagcctgagcaatggcaggcacccatcccccagcctcgctgccgcctagcagtttgatctcagactgctgtgctagcaatgagcgaggctccgttggcgtaggacctccaagccaggtgtgggatatcatctcctcatgtgccatttgtttagcccgttggaagagcgcagtattagggtgggagtgacccgatttaccaggtgccgtctgtcacccctttatttgactaggaaagggaattccctgaccccttgtgcttcccgggtgaggcgatgcctcgccctacttcggctaacacacggtgcactgcacccactgtcctgcacccactgtcaggcactccccagtgagatgaacccggtgcctccattggaaatgcagaaatcacccgtctgctgcatcgctcacgcggggagctgtagactggagctgttcctattcggccatcttggctccacctcccttaaaattctttatctggggattttatgaatttctttttgattgagatctgttgctggagaattattgtcttccttgggaagtgtcatatgtccttgctttttcatgttttctgtgtacttagatttatatctgtgcatctgttgtaatagtcacttcttcctgtttttttagattgctttcatagaggaagacttttttctgaagatctatatatgttgttggttaggtagggcattttggcttttattttgggtgcatgcagtagtgtgatttccgtatgatttattcagctgtaaacattgtcaatggtatctgtgatttcttcagtggcttagtgtgttcttattagtggaggctatggtgaagttttactagggagtaggatgccaggagggccagtgtttgggcaccagcggtggcagcagtaggccgagtgtgcctgtctttggcctccaacatgacttacactggtaccaatgttagggggcctagatgattcaattcttgggctttcagatggcttttttcaatctggtagtggccagtggtaagtctggcatgtggataggttcccaggtccttgggcagcgaatatgatatgggtgatggcagtagcaatggtggagcaacctactgaaacccaagcagtccatgctagtcctggtggtggctatgacaagttgggtgtccataacatattagttatggccactggtggtgtgtgtaggtgggtgccagctgtggtagtattggtaggttgtgtcagcctgacctcagattccaggaggagtgttaggtaccaatgatggtggactgggctgaacaatttccaggctcctacacagtatgctcaataactcaggggagggggatgggaagacacgaactgggctggcagagctggccgcctggtagtgtgttcaggtgctgtctctgataggcaagggtgaggtgaccccaggccactggcaaaatgctcaggtgtgggcagtggtggctgtgctgcaggcctgccaccatgtaggatgaggccactttcagtggtttcaatgtagggaggtagctgtgtgatgtgcagttttctcacacttcattcccatagtagcctgcagcagcactgggatttgtcctcaaagtgcagtaaaatgcctggtctccactctcccttcttggcgaggcagcagcagcagcagcagcagcagtttcaactctaaccccatgacaacacagagacctttggaggttaggctctaaaaatctacataaataattttgagtttgactttttttttttttttaactaagcattacaacatagcattttaccatcatggtgattttaaaatatgtccataaattcttttatactcttccattcaaagggtagaacctaatcacccttattcctatatttagtgacttgcttccaaagaatagaatatggcaatactagaatatatgacttccgagactagttcataaaaagcatattggctttttggcttattctttcacaccaatggctctggaggaaatcagctgccatgacatgagaacactcaagcagctaagtggaagtctcctgacaacaaccagcactaacttgctaggcatgcaagtgagctatgttggaagtatgtacttcaaccccattcaggcttttagatgactataacataggccaacatctttacttcaacttcaagagagaccctgagcctgaaccacccagctaagttgctctcaggtttctagcccacagaaattgggttcagtaataaatgtgcattgttttaggctactacactttggggtcatttgttatatagcagtagataacgagcacaactatgttataaatttctcacaaacattattttaatggctatactttatatatatttttatatatgcatggaagtataacaggaaatctaacaggaagtaatctatgttgacaggtgtaatgtcaacaacatgaaaaagttagagaaagtctcagtttttcctaataacttttatgttttattcaattcaaaggaatgaagaggtacttttctaaaacacaggctgagatattcaaaaatttcttctttctcatgctatacttaatatgtaaagaaaactacattcttcatatctacatagaagaaaaattaaataatttatctcttaaaacatttcctttatgttataatcagagaaatattctattcttcctgttctccttcaagagctgagggtatgtgtggcttttctgataattgcaatgtaatttcaatatgcaaatgatcctaaagaagaaaaagtatggatcacataaatacactatttctggaattgccgtagatgaatatcggccacacgaactattgggataaaacattatccattcagacaatcactaaatatttttgaacaattatttatgtaataagcacagcgatatcgttaacatggtagacgtgttgttgccatcacaaagcttacaattcagcataacatgcaaataagcaaacaggttatcaaaacagagtgctcaaactataaaaatcctagaagaaaacctaggaaaaactcttctacacattgacttagacattcaaaatcactaatcgtcagagaaatggaaatcaaaaccacaatgaaataccatctcacaccagtcacaatggctgttattaaaaagtaaaaaaggctgggcatggggctcacgcctgtaatcccagcactttgggaggccgaggcgggcagatcatttgaggtcaggagttcgagaccagcctggccaacatggtgaaatccggtccctattaaaaataccaaaattagccaggtgtaaaggcatccacctgttgtcccagctactcaggaggctgaggcaggagaatcgcttgaacccaggaggcgaaggttgcagtgagccgagatcgcaccactgcactccagtctgggtgacagaataagactccgtctcagaaaaaacaaaaagaagaaaagtaaaaaaacaacagatgttggcaaggtttaggagaaaagggagcacttatacactgttggtgggaatgcaaattagttcagcccctgtggaaagtagtttggagatttcttaaagaacaacaacaacaaaaaaaaggaattaccatttgacacagcagtcctactacttggtatatacccagagaaaaataaatcattctaccaaaaagacacctgcactcatatgtttattacaatagtattcacaatagcaaagacatggaagcaacccaggtgcccatcaatggtgaactggataaagaaaatgtggtacatacacaacatgatatactatacaaccataaaaaaagaataaaatcacgtcttttgcagcaacatggatgcaactggaggccattactcaaagtaaattaatgtaggaaaagaaaaccaaatactgcatgttctcattataagtgagtgggagctaagcattgggtacacatggacacaaagatgggaatcataagcactgaaaattccagactgggggagggagggaggggataagggttgaaaaactacctatcaggtattatgtttcctcaggggcttagtgtgctcttattagtggaggctatagtgaagttttgctgggtagtaggatgccaggtaggccagtcttcaggcaccagtggtggcagcaataggctgctgtgccaaacctcaacatcagacaacatacccatgtaacaaacctgcacatgtaccccttgaatctaaaataaaaatttaaagtattttttataaaacaaaatatagagtgttgagtattacaatgtggaaggagtagaatgctatgagggcacacaaaagatgaacgttatccaggtttagcaataaggtaaggctttcgaagtggaatgacctataaacagaggttaaatatagtggtatgctagtaaaatggctttccagaaaaaggaactaaagtctttatttgcaatgtttgccaatttccatagcgtaaatgttcacacaatagacaattttaagctactaatatgaaaacactgatcatgaaatttggaagacaagtaaagaatcagctctcacaagctagtacaagctagctccagtgaaccactggaaatgcctcatgaattgtgatacactctctttcttatccctccaccctagcctttgtttaggtctgtatgatgcctcatccatattactgcaataaactcgaattgacccaccatggctgactcactcctgggtcttctcctagctccctcccagttacatgcccatcacacctcttctgtgcaaaaacctttgagtgatgtaccattgcctataaaatcaaaactttatagtctgtctggcctgcctattcaacctcaacttacaccacctccttccatgcctgctatacactagccatgctaaatggtcatcactgacctgttagtcctagaatacaccatctacccacacctcaagactaataagatttgggactcaaggaggagcaagatggttgaacagaagccttcaatgatcatcctccctacaggaacaccaaatagaacaactatccacacctttgtaagaaaaaaagcaccttcataagaaccaaaaatcaggtaagcaatcaaggtacctggctttaatttcataaaacagaaacaggcactgaagagggtaggaaaggcagtcttgaattgccaccactcgatgccaccactcccccatcccctagcagtggcattgtggtattaagagagaatctgtgcacttgcaggagggagagcacatgactgtgggactttgcattgaaactcagggctgctctgtcaccatggaaagcaacgcagggcagaattcagccagcatccacagagggagcatttatgcgaggcctagccagaggagaaatatccatcccagtggtcaaaacctgagttctggcaagcagcagttcagtgctccaactaaaatgctctggggtactaaataaagttgagaagcaatccaagccacaaaggactgcaagtcttggccaagtcctgctgcagtgctgggcttgcagccagtggacttgagacatcagccagggcagccaagggagtgcttgtgtcacccttccctcaaccccaggcagcacagctcacagctctgggaaaaactctttccttctccttctcaaagagaggagaaggaagaataaagaggactttgtcttgaaccttggacaccagctcagccacagtaagataagatattgggaagagttccaatacacccattctaagccctagctccgggatgatatttctacacacacccatggccagaaggaaaaccactgccttgaaggaagggacgcagtcctggcaggattaatcgcctgctgactaaagagccattgtagtattcaccatgggcctgggataagactcagacatgctggcttcagggataacccagcactttcatagctgtggtggctaagcaaagaaacttcttctgcttgagaaaatgaaagggaaaagtaaaggggcctttgctttgcaggttgggtaccagctcagttgccgtggggtagagtaccaagtggactctgggggtccctgattccaggccttgactcttagacaacatttctgcatttgccctgggccagaggggaacccactgtcctgaagggagagtcccaggcctgacagcattcaccaaaagctgactaaaaagcacttgggccttgagtaaacattagcagtagctacacagtacttgcagtggccctggggcagtggtaaccataggaagagatgattctacttgtgcaaagaggagagaagagtgagaaggactttgtcttgtggcttaagtgccagctcagatacagaagaacagagccatagatagattcctgaggtttctgattccaggccctggctcccagatggcatctgtgggcctgtctggggctagggagaacttgcaacactgaatggaaggacacgagcctggctggctttgccacttgctgactgtagaaccttaggatgttgaggaaacataggcagtagccaggcagtggttacagtagatcttagacaagatccagtaccgagctagcttcagatatggcctcagtacagtcccagtggtggtgaccacaggagtgcgtctatcaccactgtcccaactccaggcagctcagcacagagaaagagactgtttaggaataactctgcctggtaatccagagatttcttctagatcttatccaagccgatcaaggcagtacctctccaagtctatacaagccatagcattactgggcttggggtgccccctaatgcagatacaggtgtagagaccaaaaacttagattacaacactgatatagtttggatatttctccctgcctaaatctcatgttgaaatgtaatccccagtgttggagttgaggcttgatgggaggtgtttggatcatggggccagatccctcatgaatggcttgggccatctccttggtgataagtgagctctcactctgacttcacatgagatctgattgttaaaaagtgtgtggcacctccccccaactctctctcccttgctcctgctttaaccatttgatgtacctattcctccttcaccttctaccatgattgaaagctccctaagtcttcacaagaagctgagcagatgccagcaccatgtttcctgtaaagcctgctgaaccatgagccaattaaacctttttgctggccaggcatagtggctcatgcctttaatcccagcactttggaaggccaaggtgggaggatcacttgagcccaggaattcgagaccagcctgggcaacataataagaacctgtctctaaataaataaataaataaaaatgaacctgtttgtacattactcagactcaggtatttctttatagcaatgcaatgactaatacaaggaattgctaccaagcagttggccattgctataaagatacctaaaatgtggaagcaactttggaactgggtaataggcagaggctggaaactttggagggctcagaaaaagacaggaagatgagggaaagtttgcaacttcctaaagctgggttaaatggttctgaccaaaatgctgatagtgatatggactgtgaaatccaggcaaacaaggtgtcagatagaagaactaattgggaactggaacaagtcacaccttatgccttagaaaagaatttgtgtgcattctgttcatgcccttgggatatgtggatgtttgagcttgagagtggtgacctagggtatgtggcagaagaaatttccaagcaacagtgttcataaagtagggtggctgctcctaatagcctacgctcagacaaagaaaggacttaaaattggaatttatatttaaaagggaagcagagaataaaagtttgaaaatttgggtgcctagctgtgtggcaaacaaagaagaagctttctggggagagaaattcaagcaggcttcagagcaaccacttgctagaaaattttgcatagctaaaaaggagttaagtactcttatctaaaacaatggggaaaaggccaggaaggcatttccaagactttgtggcaacctccccccccacagccccaggggcctggaaaggaagaatggcttcttggggcaggcccaaggccctgctacctttgttcagccttgggagtctgctacttgcatcccgccattctaactccagccttggctcaaaggggaccaggtacagctcaggctgccactttggagaatgtaagccataagccttgctgatttccacatggtgtttagcctgtaggcatgcagaatgcaagaatgaagaacacttggcaccctccacctagatttcagaggataaatggaaaagcctgggtgcccagacagaggactgctacaagcgcagagcctcttcagagaacctctactagggaaatgccaaggagaaatatgagattggagcccccatacagagtccctactggggcattgcctagtggtgctgtaagaagggggccaccatccttcagatcccagaatggtagatccactgggagcttgcaccctgcactgggaaaagccacagtcactcaatgtgtgagagcagccatgggggctgtatctagcaaagccacaggagtggagctgtccaaggccttgggaacctactccttgcaccagtgtgccctggatgttggacatggagtcaaagaagattattttggagctttaagagttaatgactaccctgttgggtttcaaactttcatagagcctgtagcccctttcttttggcctctttctcccttttggaatgggaatgtttacccaatgcctatgccccctcattgtatcttggaaataaataacttcttttgattttacaggtgaaaggggcttgccttatctcagatgagactttggacttgggacttttgagttcatgctggaatgacttaagactttgggggactattgggaaggcgtgattgtattttgcaatgtgaggatatgagatttggcaggggcaggggcagaatgatatagtttggatgtttctctctgcccaaatctcatgttgaaatgtaatctccaatgttgaaggtgggggcttggtgggaggtgtttgggtcatggggccagatccctctgtctcacgtgtctgtgtgaagagaccaaacaggctttatgtgagcaacaaagctgtttatttcacctgggtgcaggcaggctgagtccaaaaaaggagtcagcaaagggtggtggattatcattagttcttataggttttgggataggcggtggagttaggagcaaagttttgggggcagggggtggatctcacaaagtacattctcaagggtggggagaattacaaagaaccttcttaagggtgggagagattacaaagtacattgatcagttagggtggggcagaaacaaatcacaatggtggattgtcatcagttaaggctattttcacttcttttctggagcttcagttgcttcaggccatttggatgtctacttgcaggtcacaggggatatgatggcttagcttgggctcagaggcctgacaccctcatgaatggcttgggccatctccttggtgataagtaagctctcgatccgagttcacatgagatctgatcatttaaaagtgtgtagtggccaagtgcggtggctcatgcctgtaatcccagcactttgagaagccaaggcaggcggatcacgaggtcagaagattgagaccatcctggctaacacggtgaaaccctgtctctactaaaaatacaaaaaaaaaaaaaaaattagccacgcgtggtggcacatgcctgtaatcccagctactggggaggctgaggcaggagaatggcatgaacccaggaggcagagcttgcagtgagccaagatcacgccactgcactccagcctgggcaacagagcaagactccgtctcaaaaaacaaaaggtgtgtagcacctccccccaactctctctcacttgctcttgatttggccatgtgatgtatctattcctccttcaccttccaccatgattgtgacctccttggggcttcaccagaagccaagaagattcttgtaaagcctaaagaacaataagccaattaaacttcttttatttacaaattatccagtctcaggtatttctttagagcaatgcaagaatggcctgatacaaacaacaaagtcctttcaaatacctggaaagccaagaaggatggatacaaacgagcccaaacaacaagcactacaataaataatgtaattcttcaatacccagataccaatgaacttctacaagcatcaaaaccatccaggaaagcatgactttgccaaatgaactaaataaagtaccagggaccaattctggaaagacagaaacatgtgactcttcagacagcgtattcaaatagctgttttgaggaagctcaattaaatacaagttaacaaacacaaagaaggaattgagaatcatatcagataaatttttaaacgcattgaaataatattaaaaaagaattaagcagaaaatctacttaaatgcaatctgaatgtgcatttgacatactgaagaatgcatcagagtctttcaccagcagaattaatcaagcacaagaaagaattagtgagcttgaagacaggctatttgaaaatacataatcagatgcaaaaaagaaaaaagaataaaaaggaatgaaacatacctaccagatcaagaaaatagtcttgaaagggaaaatctaagagttattggccttaaacaagaggtgcagagagagatagggacagaaggtttattcaaagggataataacagagaaattctgaaacctacagaaaaatatcagtattcaaatataagaaggttatagaacacaaagcagatttaacccaaagaggactgcatgaaggtatttaataatcaaattaccaaaggtcaagaataaagaaagaatccaaacagaagcaaaagaaaagaaacaaataacatacaatggagctccaatgcgtctgacagcagacaaagtactgagggaaaaatttttttaccctagaatagtatatccagcaaaaatatccttcaaacatgaaggagaaataaagactttcccaaacaaaagctgagggatggcatcaacaacagacctatcctacaagaagtgctaaagaaagttcttcaatctcaaagaaaaggacaataatgagcaataagaaatcagctgaaggtgcaaaattcactggtaatttcaagtacccagaaaacacaggatagtataacactgtaattgtggtgtgtaaactacttataacttaagtagaaagaataaaagatgaaccgatcaaaaataatacaagaacttttcaagacatagcacaatgagatataaatagaagcaaaaaaatttaaaagcagagagatgaagttaaagtatagagtttttaacattgtttttgcttgtttgtttgttagattattttttaatgcaatcagtgttaagttgtcatcactttaaaataatgggttataacatattatttgcaagtttcatgataacctcaaatcaaaaaaaaatgcaaccgatacacacacaaaaaaagcaagactttaaaacacaccgccagagaaaatcaccttcactaaaaggaagataggaaagaagaaaagaaggaagagaaaaccaaacaataaccagaaggcaaatagcaaaatggcaggagtaagtccttacttaacaataaattcactgaattaactatccaatcaaaagacatacagtggttgaatgggttaaaaaaaaaaaacaaaaaaaaaaacacaagacccagtgactggttgccgatcagaagcacacttaacttataaagaaacacatcaactgaaaataaagagttgagaaaagactttccatgcaaatgaaaaccaaaaaaaagagcaaaaaaatagatttcaagacaaaaactataaaaagagataaaaaatgtcattatataatgataaaggggtcaattcagcaagatgatgtaaaaattgcaaatatataagcatccaatactggagaacccagacacataaagcaaatcttattagagctcaagaaagagatagaccccaatacaataatagccacagatttccacaccccactttcagcattacacagatcatccagacagaaaatctagaaagaaacatcgtacttaaacttaactgtagaccaaatggaccaaatagatatttacagaacattttatccaatggctgcagaatgtacattcttctcctcagcacatggattattctcaaaaatagaccacaggttaggccaaaaaacaagtcttaaatcatttttaaaaactgagatcatatcaactatcttctctgccacaatggaataaaagtagaaatcactaacaagagtaattttagaaactataccaaagcgtggaaattaaacaataaactcctgaatgaccagtgggtcaatgaagaaattaaagagaaaattgaaaaaaattttggaaacaaatgataatggaatcacaacataccaaaacctatgggatacagaaaaagcagtactaatagggaagtttatagctataagtgactacatcaaaaagaggaaaaactcaccatgaacaagctaaccatgcatcttaaagaactagaaaaggaagagcaaaccaaactcaacattagtagaagaaaataaataataaagatccgagctgaaataaaattaaaatgaaaaaatgataaaaaaaaatcaatgaaacaaaaagttgtttttttcagtgtggagattccttaaggaaaaaaaagtagaactaccatttgatccagcaatcccattactgggtatctacccaaaggaaaagaagtcattacatgaaaaagatatttgcacatgcatgtttatagcaggacaattcgcaattgcaaaaatgtggaaccaacccaaatgcccatcaatcaatgagtggataaagaaactgtggtataatatatatgatggaatactactcacccttaaaaaggaatgaattaatggcattcacagcaaccaggatgggattggagactattattataagtgaagtaactcaggaatggaaaaccaaatattgtatgttctcgctcataagtagggctaagctatgaggatgccaaggcataagaatgctacagtggacttcggggacttgggtggaaagggtaggaaggcggacagggataaaacaccacaaattgggttaagtatatactactcaggagatgggtgaaccaaaatctcataaatcaccactaaaacttactcatgtaaccaaataccccttgttccccaaaaacctatggaaataaaaactaaaaaaaaacaaaacaaaacatttttttagaagttggttttttaaaatgttaaaacaatttgacaaacctttagcaagatgaactaagaaaaaaagacagaatttctaaataaaatcagagatgaaaaaggaaacattaaaattgatatcacagaaattcaaaggatcattagtggctactttgagcaactatatgccaataaattgggaaagctagcagtaatggataaattcctaaacacatacaacctatcaagattgaaccatgaaaaaatccaaaacctgaacagatgaataacaagtaatgagatagaagccataattgaaagtatcgcttctcagccttttggctaagaccaagtatagaagccataataaaaagtctcccagcaaaaaaaagacaagaacccaatggcttcactgcagaattttgctgattatttaaataggaactaataccaatcctattcaaactattctgaaacatagaggactggggaatacttccaaactcatcctacgaggccaatatgaccctgataccaaaaccagacaaagacacatccaaagaagaaaactacaggccaatatccctgatgaacattgatacaagaatcctcaacaaaatactagcaaatcgaattcaacaacacattaaaaaaaatcattcatcatgaccaagtgagatttatctcagggatgcaaggatggttcaacatacaacaaatcagtgagacacatcatataaacagattaaaagacaaaaaccatatgatcatttcaaatgatgctgaaaaaacatttgatgaaattcaacatcctttcatgataaaaaccttcaaaaatactagatttacaaggaatattccccaacacaataaaaaccatatatgacagactcacagctagtgtcatactgaatggggaaatactgaaagcctttccttagatctagaacatgatgaggatgtccactttcactactcttattcaacatagtactggaagtcctagctagagcaatcatacaagataaataaataaagggcattcaaacaagaaaggaagaagtcaaattatccttgtttgaaaatgatatgatatacttggaaaaacctaaagattccactaaaaactaccagaactgaaaatcaaattcagtaaagttgcaggatacaaaatcaacatgaaaaaatcagtagcgtttctatattccaatagcaaacaatctgaaacagaaattaaaaagtaatcccatttaaaatagctataaataaaatataatatctaaaaatttacttaagcagacaaatgaaagacgtctacaatgaagagtatataagactgatcaaataaatggaagagaacaccaaaaaatggaaagatattccaagttcatggattggaagaatcagtattgttaaaacgtttatactacctaagacaatctacagattctatgcaatccctattaaaataacaatgacattcttcccagaaatagaaaaagcaatcctaaaatttatatggaaccataaaagaaccagaatagctttggctattctggtgaggatatggagaaaaggaaaccttcatacactattggtgggaacgtaaattagtatggccactatggagaatagtttggaggttcctcaaaaaactaaaaatagagctaccatatgatccaacaatcccactgctaggtatattccttccaaaagaaaggaaatcagtatattgaagagatatcttgatgcccatgttttactgcagcactgttcacaatggccaagatttggaagcaacctgagtatccatcaacagataaatggataaggaaaatttggtacatatacacaatggggtactactgagccataaaaaagaatgagatcctgtgatttgcaacaacatgaatggaactggaggtcactatgttaggtgagataaaccaggcacagaaaggcaaatttcacctgttctgacacatttatgggagttaaaaattaaaacaattgaactcgttaagacagagaatagaatgattgttaccagaggctgagaagagtggtgcaagggggatggttaatgggtaccaaaatatagttaaatagactgaaatctagtatttgatagcacagcagggtgagtacagtcaataatgatttattgtccattttaaaataacttaaaaaacctggatcgtttgtaacacaaagaaaggataaatacttgagttgatgaataccccatttaccagatgtgattattatgcattttatgcctgtatcaaaatatatcatgtaccccataagtatgtacacccactatgtatccgtaataattataagaaatgaataatgacataggcaatattcattgaatactaattaaatgccagggaagctttcaagcactgaaaatacaaatatgaataagagacaatctctgatctccacaatagtggaatgggcagacagacatgtaaattccttattataatggtttgtgatgaacacatttacctacaaggatggatacaacgcataatcaggaacagacaatagcactgagtcctataatacagcctgaaatgtggtagctgtgaaataagtatttgttaaatacatgaattagtgacataatgcagaatccgggaacacttcatacaagaagtaccatttgagtaaggcagtgctcacaagaattattttaagcactcagagaagagagagctcactgcttattggagagaaaaccaacaaaataattttaaaagacgatgtataaagacaatgaattctgaaagacacatctagagacctacagagcctccaggtcttcaaacctttgcagacttatgcaatgagctatggtttgccaacactcactgaccacgagaatcatctaaggagtgtttaaaaatgaaatatattcctgtgacacagcctgatctcttaaaggtacctcggcaggaaccactagtttcaaaaatcttcccacatatctgatattcatccctgattgagaaccactgcatagaccctacccctccacaaaaaaaggctgtattgggattatctattgagcagagaagggaagagatagagagaaactcagcaaggccaacctttggtgacctcctttctctaatggcagctattaacaagtcttccctgcagcagaagcttacctttgagagctctgcccgccaatacttcaggtaatattcgctatcattccagctgcctttattgaagttgacgtgggttatatatttattttggtcccctatatgcacaaaacaaggtattgttcagaagtccttgagaagaatgtctcacgtatctgttcttgccataatgttaccgtctaacaaggtacagacaaagaaatggaaaagtcgggaggcagtggggaaggaagaattgaattacttccctcactgctaaaaaagaagccacagtcgaggtgtgtgtacaccaccctaatctgatctgaacaaagatataaatgtcctttataaagccttgagccgagggatcctcaaatgactgggtaaatttctggtacttcacagaaaacagtttatccttaattttcaattttatttaaaatgcaagccttcggtgtcttttcacggttcaaagtaatacagttcactgtaaaaaaaattacacaacacaaaaatgaaacaaaaaataaaacaaagtcctatacacccctaagagaaaccgttctgctatttaccttgtgttagtctggaaaactttgatatacatgtaagctaaaatgttattaccccatacatactattctgtagccttttaaaaatcacttactagcttgtggtattatttctatgtcaatgcctataaatatagcctgtcctttaaaataaacacctctttttccattgtatggatggatatttgggttcatgacagttttgctcttataaacaacactgaaacaaaacaccctttggatactaatgtgattatctcctttcactaagtgaattcttgggacaaaaaaatggtgagtatattttaatacaagcttgccttctaggaaagttagtcaatttagactacctccacactgtaggaaattgcctgttacctcacatcttcatccattcttgggcattagcaatcttttgaatctttgacagtatggtagctagaaaaaaatgtaccaccttattgtcattttaatttgtacttctctaatttttgtgaagttaagcagcatttttctcttgtttaccgacatttatatgaacttctccttttggaaattaccaacttgagccctttgcccattttaaaatttatatttatgtctgttctattaatttgtaaaagtatatttgcataagaatatgatcctaacattgtggcatctttgttatacgctttttaatcatgtttttactgttgatgtgccaattttattatttctatgtgatcaaattgatccatttttttttttaatggagtaggactttagggccaaaccaaggaaatctctcataccctcccaatattcaaactgatttttctatttttcctacagtaatcacatggtgtcatttttcacatctaaattttaaatccatctggaacttatttttgttaatggcatgaggaagaagccaaccttgtgagccaccctcctctcattttcagacagcttcatgtgtttagctatatatatcttgtaggtaaatgttcagcctcagtgaatttagtttcagatgcagctttttttttcttgttttaagctcacatcctttgagttatgggaagacaggaataaatttagtagatttactcattacacactgcattccacagaggtaaatggtcctatataatccatttgtaccaggtattgctcagtagaaagaacacttacgtagtctactccattgcttttcaaactattctaagaatataccagacccctaatacaaagtaatgaaaaagaaattatattgatactggaatcaactgcagtgttaaagtagcttaaaatcagacattctatctttaaaaaaaagaaaaaaaacttacaattttcctttacttacctgtccaaagaaggcttcccattctcaaatatgagatatcttaaagcaagatttgatcaaagcaagtgtcaaagatcaagtgatattatgataatttataagtacctataataaatttagtgcatcaactagtgtattcagaaaataattcctggaaatacataaagatgaaaataagcacagcacttatttttgaacagcataaaatatatgcatatatattatatataaaatgtctacggccataccatcctgaacgcgcctgatctcgtctgatcttggaaggtggatttttttaatattgaattttgaataaaaagtttactgaaaagttcattcctataattaataataaagtgtaatgtaattgaaaattgctaagagagtagattttaaatgttctcattaccaaactgataagtatgtgaggcgattgatatgttaattagctttatttaatcattccacaatgtatacctatgtaaaaacatcacattgtacaccataaagatatataatttgttgttttttcaatcaaaagtaaaaataataaatagtttcacctttagaagtctgaaacatactatttcaaactccactgttttggttatctattgctgcataagaaattaccactaaaattcattagcttaaaacagtaccctttaaaaaaatacatctcaaaattttgagggtcacaaattcaagcaggactcagctaggtgattcttctactccatgtggtgtcaactgaagtcatctggtgggattcagttggcaaataggctggtctggagggtctaagaagacttcactcacatatctgtcaccttggcagggatgctttaaagtctgtgttcagctagaactgtcaatcagggtgcctacatgcagtccttctagcatggtggtctcagggtagttggatttcatatgtcttcagtctttttatggacttcatacatattcaatctttataaaaagatttataggtctgttaagattttctatttcttcttaaggaagttgaggtcgtttttgaatttctgggaatttgtccattttatctaactaatttcattcatttgcatatgaatgttcatagtattctcttataatcttctctctatgagttctgcagtaatgctcccactttaatttctgaatttatcaatttgagtcttctctcttttcttcttgatcagtctacctaaagatttctcaattttgttaatatattcaaagactcaactttcaactgcactgattcagtattttaaattttacatatctccattctaatctttcttccttccttcctttttctatcttttggtttagcttggtgttctttgcagttcctcagggagcacagatatattctcaatgtggaatgtttcttcttcttttttcttttttttttgagacagagtcttgctgtattgcccagcctggaatgcagtggcatgatctccgctcaccgcaatctccaaatcccagattcaagcaattctcctgccttggcctcccaagtagctgggactacaggcgctcgccaccatgcctggcaaatttttatatttttagtagagacggggtttcactatgttggccaggctgatcttgagctcctaacctcgtgatccacccgcctcagcctcccaaagtgctgggattacaggcgtgagccacagcacccaaccttttctttttgaatatagtcatttaaagctataagtttccatctgacgattgcttttgaaatattctataagttttagtatattgtgttttaatttgcattaatctcaaagtaccatataatttaacttgtaatttcttatttgactcatttgttgtttgagtgtgttgttcaatttccacgtttgtgaattttccagttttcttcctgccatttcatttctactgtgatcatagaagatatatagcagtgtgaaaaatggactaatacactgacttaaaaatgtactacaaatctatagtaacgaaaatatcatggtactgaaattaaaacagacatatagaataatggaacaaaatagagatcccagaaataaatccacacacttacccacaaaacaatttttgacaaaaatggcaagaacacagtttggggaatggactatgtcttcgatatgtcttcaataaatggtactgggaaaactggatagctatatgcagaagaacaaagctagacctgcatttctcaccataaacaaaaatcaactccaaatggtttgaagacttaaatgtaagccttaaatcaataaaactaatagaagaaagcataagggaagcacttcatgacaataatatggacaaggattttttaaaataagaactcaaagtacaggcgacaaaagtaaaaacagacaaattggattacaacaaactcacaaaattctgcacagcaaaggaaacaataaagtgaagacaaaatctacagaacgggaaaaatatttgcaaactgtgcatctgaaaaggggttaatatctagcatatacaaggaacatgaacaactcaatagtaaaaaagaaactaattaaaaatggtcaaaaagacctgaataaatatttctccaaagaagacatacaaatgtccaacaataaaatgaaaaatgctcaatatcactaatcatcaggtaaatgcaagtgtaaactacaatgagatgttacctcatcacaattagaatggctaatacaaagaaaagaatacataacaaacactggcatggatgtaaaggaagggaacacttacatactgttgatgggaatgtaaattagtatagacattatggaaaatactatggagatttctcaaaaacattaaaaatagaactaccatatgatctagcagtctcactattgaatatatatccaaagaaaaagaaatcagtatgttgaagagatatctgcactcctatgtttattgctgcactattcataatagccaagatgaaatcaagctaagcgtccatcaaaggatgaatgcataaataaaatgtggtatacatacacaatgcaatactattatttaatagtattttaaaataatacaatcctgccatttgcagcaacatgaatgaacctagaggttattatgttaagtgaaatacgcccagaacagaaagacaaatactgcatgatctcactcatatgtggaatctaaataaagttgaactcatagaactagagagtacagtagtggttaccagaggctggagatgggggagtggagagcaaaataggtagggataaatcaagggttacaaagttacacttagataggagaaatacgtttgggtgttctattgcacagtagggtgactatgattaacaacattgtattgtatatttcaaaatagctagaagaaactattttgaatattccctccacaaagatatgataaatgtatgagatgatggaagtgctaaatactctgatttgattagcacaccacatatacatgtattgaaacattacactgtacctcataaatatgtacaattatgtctcagttaaaacagaaataaaaaaagaaaaacaaaataaaatatataatatccttccttgtcacttataccactttctatataaaatcctattattccatctagtactagtccagccaccccaggtgtcctttttagtatttgcatagaatgccttttcccattcttttactttgaatttatttttgtctttggatctaaagtgtctattatagccagcatatagttaaatcatatttataatccattgtgccaatctctgccttttgattggagactttaatacattcacattgaaaatacttactgatttaaaaagaggacttacttttgccattttactttttgatttttatatgtgttataactattttgctgctcaattcctaaacaattaccctctttcgtttgattaatagtttcaatacactctttatctctcttcgtttctcttgattctctattcatttcctctctatatatctttaaggggttgttttagtggttactctgggaattacaactaacttcttcactttaaaatactcgaattaatatcaacatagtttcaatagcatcttaaaaatcctctttaatacctctctcccatttggtattatcacaaattatattgttatacattgtgtgcccatcatgcactcatatttcaaatcatctaggaaaaaaaggaggagttataaacctaaaatctaagacgaccggctgttacgtttacctatgcaactaccattaccattattttttattcctttttatggccttgagttcctttcatttcaacctgaatgaattcctttagcataccccttaagggaggcctactagtgacaaactccctccgtctttgtttatcaaaaacaatttaatttctcctttattttagaaggacagttttgcagatacacaattcttgattttttttcttccagcactttaaatatgtcatcccactctcttttggcctccacaattctaataagaaatcagctttttccctgtcttttgcattttatattgatatatcatagttgcatgtattttgtgggtacatgtgatattttgatacatgtatacaatgtgtaataataaaatcagagtaaataggatacccatcacctcaaacatttatcttttccttctgttgggaatattacacttcttcttatccagctattctgaaatatatgacaaattattgttaaatgtaatttccctgctgtactattgaatactagaactcatcccttctatctaattgtatttatgtaccactaaacaacttatcctttgcatatgaaaagttgcttcttgtgctactttcaagattctcacgttgtgtttcaagagttttatgacagtgtgtcttggtgtaaatatattcttataaaattttttcttttaatttttgctaatacatactacgtgtatatattggggtacataagatattttggtacagcaatgcaatgcataataatcacataatggaaaatggggtatccatcacctcaagcattaaccctttgtgttacaaacaattcaattatatactattttagtaatttttcaaagtacacttaaattattattgactttagttcctctgtggtgctatcaaatactaggccttattcattctttctaactttttctgtacccattaattaaccatacatccctgagattcccactacccttcccagcctctggtaattaacattctattctctatctccattagctcaattgttttgacttttagatcccacaagtaagtgagaacacgtgagaactgtctttccatgcctggcttatttcacttaacatgatgacctccagttccattcataatgttgcaaatgaaaaaaatctcattattttttatggcaggatagtataccattgtgtatatgcaccacattttctttatccagtcatctgttgattgacacttaggcaacctaagcaacacttaggttgcttccaaatgttagcagttataaacagtgccgcaacaaacacaggagtacagatatctctttggtatactgattttctttctcttgggtatataccagcagcgggatccctgggtcacctgataggtccatatttagttttatgaggaacctcaaaactgttttccatagtgtttgtgctaattgtagattccaacaaacagtgtatgagggttccctttctccacatcctcatcagcatttgttatagcctcttttgaatatatgccatttttaactggggttagatgatatcccattgtaatttttatttgcatttctatgatgaacaatgacattgagcaccatttcagatgcctgtttgtcacttgtatgtctccttttgagaaatatctattcaaatcttttgcccatggtttaatcagattattagattttttcctatacagttgtttccattcttcatatattctggttattaatcccttatcagatgggtagtttgcaaatattttctcccattctgtgaggtgtatcttcactttgttgattgtttcctttgctgtgaaagaagctttttaacttggtgagctctcatttctccattttgtctttcattgcctgtgttggtggggtattactcaaaaattttttgcatagccgaataagctggagataaatcctacatagtcataatgaataatttttttgttgttatactttaagttttagggtacatgtgcacaacgtgcagctttgttacatatgtatacatgtgccatgttagtgtgctgcacccattaactcaccatttacattaggtatatctcctaatgctattcctccccactccccccaccctacaacaggccccagtgtgtgatgttccccttcctgtgtccatgtgttctcattgttcaattcccacctatgagtgagaacatgcagtgtttggttttttgtccttaaaatagtttgctgagaataatggtttccagcttcatccatgtccccacaaaggacatgaactcatcctttttatggctgcatagtattccatggtgtatatgtgccatattttcttaatccagtctatcattgttggacatttgggttagttccaagtctttgctattgtgaattgtgccgcaataaacatacatgtgcatgtgccttatagcagcatgatttaaagtcctttgggtatatacccagtaatgggatggctgggtcaaatggtatttctagtcctagatccctgaggaatcgccacactgacttccacaatagttgaactagtttacagtcccaccaacagtgtaaaagtgttcctatttctccacatcctctccagcacctgttgtttcctgactttttaatgatcaccattctaactggtgtgagatggtatctcactgataccatctcattgaggttttgatttgcatttctctgatggccaatgatgatgagcattttttcatgtgtcttttggctgcataaatgtcttcttttgagaagtgtctgttcatctccttcacccacttattgatggggttgtttgtttttttcttgtaaatttgtttgagttcattgtagattctggatattagccctttgtcagatgagtagattgcaaaaattttctcccattctgtaggtcgcctgttcactctgacggtagttctttttgctggacagaagctctttagtttaattagatctcatttgtcaattttggcttttattgccattgcttttggtgttttagacatgaagtccttgcccatgcctatgtcctgaatggtattgcctaggttttcttctagggtttttatggttttaggtctaacatgtaagtcttcaatccatcttgaattaatttttgtataaggtataaggaagggatccagtttcagctttctacatatggctacccagttttcccagcaccatttattaaatagggaatcctttccccatcacgtgtttttgtcaggtttgtcaaagatcacatagttgtacatatgtggcattacgtctgagggctctgttctgttccattggtctatatctctgttttggtaccagtaccatgctgttttggttactgtagccttgtagcataccttgaagtcagaaagcgtgatgcctccagctttgttcttttggcttaagattgacttggcaatgcaggctcttttttggttccatatgaactttaaagtagttttttccaattctgtgaagaaagtcattggtagcttgatggagatggcattgaatctataaattaccttgggcaatatggccattttcacgatattgattcttccaatccatgagcatggaatgtccttccatttgtttctgtcctcttttatttcattcagcagtggtttgtagttctccttgaagaggtcctttacatcccttgtaagttggattcctaggtattttattctctttgaagcaattgtgaatgggagttcactcatgatttggctctctattggtctgttattggtgtataacaatgcttgtgatttttacgcattgattttgtatcctgagactttgctgaagttgcttaccagcttaaggagattttgggcagagacaatggggttttctagatatacaatcatgtcatctgcaaacagggacaatttgacttcctcttttcctaattgaataccctttatttccttctcctgcctgattgtcctggcaagaacttccaacactatgttgaataggagtggtgagagagggcatcactgtcatgggccagttttcaaagggaatgcttccagtttttgcccactcagtatgatattggctgtgggtttgtcatagatacctcttattattttgagatacgtcccatcaatacctaatttattgagagtttttagcatgaaggattgttgaattttgtcaaaggccttttctgcatctgttgagataatcatggggtttttgtcattggttcttttatataatgcattatggttattgatttgcgtatgttgaaccagccttgcatcccagggatgaagcccacttgatcatggtgaataagctttttgatgtgatgctggattcggtttgccagtattttattgaggattttttcatcaatgttcatcagggatatttatttaaaattatctttttttgttgtgtctctccccggctttggtatcaggatgatgtggcctcataaaatgagttagggaggagtccctctttttctattgattggaatagtttcagaaggaatggaaccagctcctccttgtacctctggtagaattcggctgtgaatccatctggtcctggactttttttgattggtaagctattaattattgcctgaatttcagagcctgttattcagagattcaacttcttcctggtttagtcttcggagggtgtgtgtgtccaggaatttatccatttcttctagattttctagtttatttgcatagaggtgtttatagtattctctgatggcagtttgtatttctgtgggattggtggtgatatcccctttatcattttttagtacgtctatttgattcttctctcttttcttatttgtcttgctagcggtctatcaattttgttttttttttcaaaaagcagctcctagattcattgattttttgaagggttttttgtgtctctatctccttcaattctgctctgatcttagttatttcttgccgtctgctagcttttgaatgtgtttggtcttgctttatttctgccttcatttcgttacatacccagtagtcattcaggagcaggttgttcagtttccatgtagttgagcggttctgagggagtttcttaatcctgagttctagtttgattgcactgtggtctgagagacagtttgttataatttctgttcttttacatttgctgaggagtgctttgcttccaactatgtggtcaattttggaataggtgtggtgtgctgctgaaaagaatgtatatactgttgatttggggtggagagttctgtagatgtctcttaggtctgcttggtgcagagccgagttcaattcctggatatccttgttaactttctgcctcgttgatctgtctaatgttgacactggggtgttaaagtctcccattattattgtgtgagaatctaagtctctttgtaggtctctagggacttgctgtatgaatctgggtgctcctatattgggtgcatatatattttggatagttagctcttcttgttgaattgatccctttaccattatgtaatggccttctttgtctcttttgatctttgttggtttaaactctgttttatcagagactaggattgcaacccatgcctttatttgttttccatttgcttggtagatcttcctccatccctttattttgagcttatgtgtgcctctgcacgtgaaatgtgtttcctgaatacagcacactgatgggtcttgactctttatcgaatttgccagtctctgtcttttaattggagcatttagcccatttacatttaaggttaatattgttatgtgtgaatttgatcctgtcattatgatgttagctggttattttgctcgttagtggatgcagtttcttcctagcctcgatggtctttacaatttggcatgtttttgcagtggctggtaccagttgttcctttccatgtttagtgcttccttcaggagctcttttatggcagggttggtggtgacaaaatctctcagcatttgcttgtctgtaaaggattttctttctccttcacttatgaagcttagtttggctggatatgaaattctgggtggaaaattctttttattaagaatgttggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaacaaaaaaaaaaaaacaaaaaaaaagaatgttgaatattggcccccagtatcttctggcttatagaatttctgccgagagatccactgttagtctgatgggcttccctttgtgggtaaccccacctttctctctggctgcccttaacattttttccttcatttagactttggtgaatctgacaattatgtgtccaatcttttttcaagatttttaacttctttgccattagttagaacttcctcctttagctcagagtagtttgatcatctgaagccttctctcaactcgtcaaagtcattctctgtccagctttgttccattgctggtgaggagctctgttcctttggaggaggagaggcgctctgatttttataattttccgtttttctactctgtttcttccccatctttgtggttttatctacctttggtctttgatgatggtgacgtacagatggggttttagtgtggatgtcctttctatttgttagttttccttctaacagtcgggaccctcacctgcaggtatgttggactttgctggatgtccactccagaccctgtttgcctgggtatcagcaggggaggctgcagaacagcggatattggtgaacagcaaatgttgctgcctgatcgttcctctggaagttttgtctcagaggagtacccggccgtgtgaggtgtcagtctgcccctgctggagggtgcctcccagtgaggctacttgggagtcagggacccacttgaggaggcagtctgtccattctcagatctcaagctgcatgctgggagaacaactactctctcaaagctgtcagacagggaggtttaactctgcagaggtttctactgccctttgtttggctatgccctgcccccagaggtggagtctacacaggcaggcaggcctccttgagctatcatgggctccaggcagttcaagtttcccggccgctttatttacctactcgagcctcaggaatggcgggcgcccctctaccagcctcgctgtggccttgcagtttgatctcagactgctgtgctagcaatgagcaaggctccgtgggcgtaggaccctctgagccaggcgtgggttacaatctcctggtgtgccgtttgctaagaccgtcggaaaagtgcagtattagggtgggagtgacctgattttccaggtgccgtctgtcacccctttccttggctaggcaacgaaattccctgaccccttgcacttcctgggtaaggcgatgcctcgccctgctttggcatatgctcagtgcgctgcacccactgtccgacaatccccaatgagatgaacccagtacctcagtcggaaatgcagaaatcacacgtcttccgcatcgctcacgctgggagctgtagactgaagctgatcctatttggccatcttggctccacccgaataatatttttaatgtactgttgaatttggtttgctagtattttgttgagaatttttgcatcaatattcatcagagatattggcctatagtgatcttttctttatgatgtgtctttgctgggttttcatatcagggtaatattggcctcatagaatgagtttgaaggtattcctgcctcctctgtttttcaaaacagtttgagtagcattggtgttagctcttctttagacatttggtagaatacagcactgaagccattgtgtcctgggcttttctttactgggagactttttattttggtttcaatctcattactggttgctggtctgttcatatatcagatttcttcatggttaaatctgggtagcgtctgggcacggtggctcacgcctgtaatcccagcactttgggaggcggaggcaggcgaatcacgaggtcaggagatcgacacaatcctggctaacacagtgaaaccccgtctatactaaaaatataaaaagttagccaggcgcggtggcgggcgcctgtagtcccagctactcaagaggctgaggcaggagaatggcgtgaacccaggaggcagagctcacagtgagccaagatcatgcatgccactgcactccagcctgggcgtcagagccagaccctgtctccaaaaaataaaaaataaaaaaaatctgggtaggttgtatgtatctacaagttttcccatttcttccagatttcccgatttactggcataaagtgtttcatagtggccactaaagatccttggaatttctgtgatatcagttttaaggtctgctttttcatctctgattttatttagtggggtcttctctcctttttttcttagtttgtctagaggttcatcaattttgtttatcttttgaaaaactaccttttgttttgttgctcttttgtattttttatttcaattttatttatttctgctcggatctttattatttcttttctactattaattttcagtttggtttcctcttgcttttctagttcaagatgcatccttagattgtttgtttgaagttttttctcttttttgatgtaggcatttatagctataaaattccctcttagtctctcagtactgctttcactgtatcccataggttttggtatgctgtgtttccattatagtttgtttcaaaaagtttttcaatttccttcttaatttcttcattgactggtcattcaggagcatattgtttaatttctgtatgtttgtatagtttccaaaattcctcttgttatattcctagttttattccattgtggtcagagaaaatgcttgatattatttcaatttttttaatgttttaagacttgttttgtgatatagcatatagtctattcttaagaatgatccatgtggtaaggggaataaggtgtattctgcagccattaaataaaatgttctgtaaatatctattaggtccatttgttctataatgcagattaagtctgaagtttctttgttgaatttatgtctgggacatctctcgaatcctgaaagtggggtgttgaagtctccagctattatactattggggtctacttctcacttaagctgtaataatatttgctgtatatatctgggtgctgcagtgttgggtgcatgtatccttacaatcattatatcctcttgctgaatttacccctttaccattatataacgaccttctttgtctcaacttacagtttttgtcttaaaatctatttgtctgatgtaagaatggtgactcctgctcctttttggtttccattgggatggagttgctttttccatccctttactttcagtctatgtatatccttacaagtgaagtcagtttcttgtaggcagcaggtcattgggtcttgttttttcatacattcagccattctgtgtcttttgttttagtcctttatcattcgatgttattattgataagtgaggactagctcttgccattttgttatttgttttctgattattttgccatcttctcttccttctttctttccttcctgcctcccctttaacgaaggtaattttctcaggtggtatgttttaatttcttgattattattttttgtatatctgtggcatgttttttgatttaaggttaccatgaggcttgccaatactatattataaaccattattttaaactgatgacaacttaacacttatttgtaggtctctttgaattatcctgtttcaaggtcgttatgcttcttggatgtatagattcctgtgcttcatcaaatttgttgagtttctgtcctttattttttttaaatattctttttttgtctttttactctctactattcctctttctctgtgactcccaggaagtctatatttgtttgttttgttcctcacaggtctcatagactctgttcaatttttcattattttctatttctgcttctcaaactggattatgtcaattgacgcatcttcaagttcactggatctttcttttgcctgatcaaatctgctgttgaatccccctaatgaatcttcatttcagttattttacttttcatcttcattatttctgtttggctcctttttatgatttctttctctttattgaaatatcctacttggtgagatatttagttctttgtccatggtttcctttggctctttgagcatgttttatgcagctgttttaaagtttttatctactgaggccaatgcgtgggcttcctcaatgacaatttgtattaacttctctttcattgggaacgaatcatatttcttgtttcttgaaggcatcatgtatttttgctgaaaagagaattttttgaatattataacatctcaacttggacatcagattctccttcctccatgctattcattatttctcttgttgtgacttgttgtttggttagtgacttttctaaacttttaaaagtaaattttatattatttgccatgtgcagccactgaagtatgtgttttataacttagagttcagactgtgtttttaaagagagtgccttaaatgactggaactaatacaaaaaggaaggaaagaaaagaaaaagaaagagactctccaagacactggattggttcagggttggcatatcactttaatgcttagccaggccactttcacctctgctttagtcttcacttcctttttgtaaagagcctgaaagtcagccacagataaaaccttagggtagttctaagccttctccaagcacacatccagttgtgagcatgtacatgcccttctctattcctcagtacatgtgattgcatttaaatgtttttattcctctttgtatttcctttcaacctttttcttccaaggcttttgtttgtttgtttctctatcttttgtgtcaacaattatcacttgacccatgtggccaaattctgcacttcgtttattcagaaatgaaaaatgttaagccatcacattcttgggaattctctgactctggtaaaacaaagacaagcccttgcacccgtctttgaggtttccacaagagagataaatccacaaccaatcattctttgaaataagtccgtatctccccctctggcactagcaacctgcaccaggagtacaggctgccattttcatagacaccggctatctgtaagtaaggaatggcaagtgggaaacaaaatgccacagtgctatcttaacacagtgctatggcagcttctttcttcctaaagatttcccctgattgctttaactttttatttgtgagttctgtgaaagttgatactctccattttttgcagctaatattattttttgtggagggacaaagccctggaattcactactctgccaatttaggtgatatctatgagttattttttgagtagtggttacaatttcagaaccaaattttagtgtttgaagaagcttagaagttaaccaacctaaccatcctacattcagatgaagtgagaatgttctttacaacatcctagctaataatgcctataattgttgaaggaacttctatgtgccagaaacttaacatttgtcattttgataataacatcttaagataaacattgttgtctcctctttttagctgagaaaatcaaagtccataaaggttcagaaaattttacaagatcatcaaggatttgaacccaggtttaactgacttcaaagaccagtctttccatcctgccacactactgctccctacttcatataccagtgagctcacttaagcaatagatagtttggtataaagatgaccccccagtagtcagaagtgtaatgattagaacaaactatctctaaaatccttttcctcataaattccacttagtgaacctctaggcctatcatctagaggaatgcagaaaaaatcacacacacttcaacaactatctggagagaattatcttaaccctttttagtcttctttaccccagaatgaacaccctcagttatttcaacccctccttatataacattgatataactcaatgaaccattttttaagttatctgtcagattattctgttttgtcacagtccaactaaacaaggatgagaccaataatagcatgcaccactccagaggagacttgatggcatgcagggagactgggttgctcttctgtttatgttgaccatgatttcgttacctttttaagaaagtatagcatactgatggctcatattgagcttgcagttaacccacattcttgaaaaaagctacctccaagccagctcacttgccttctatagttctgcacttgattttccataagctaaaatataggcatgtacatttatccatgattaattggaaccttttagttttaaattaatatttatgcccatcaaggacatttttaatattaatttcattatctctggtctctgtcagttatgtatcatctaaaaagctgataaatatgctgatattttgttaagcaccacactattctccagatcaacatcaatacattaaccaaggctctttgatcaaccagctgtgaattatacttaaaggtgcaatgaccactcccatgtctcacctgcccatagcagtgtcatgagagcgattttcagatgctctactaatatcaagatgtatcatgtttatagtgtttttctattcttctaatctagcaatagtctctgaaaaggaataaaactagggcattcttctttttaaataaatgctaaatccttccttttaaaagcattataataaaaatcacctaattgatcaatattctaccctaaaatttttaaagtatttatcagaattgactatatttcccttttcgaaagcacaaaactattttgtattttaatatctctggttgtctcatataatttataaatttataaacattaataaattttaaaagattatttaccacaactgattaaaataaggagtaactaaaaacaacctaaatctccaacaacaggggtttggtaaagcaaatcatcgtggatttattagagtggaattccggtttaaaatttatagtatctggaatgaccttagtaagatggcagaataggaagccccaggctttattcctccaaggagaaactgacttaacagtatatagtccaaaaagccttatgagaactccaggaacaagttaagaagttacagtaccccaggaaagcacaaagccaagtacagtcacattgaaacaggtccgaaaagccattgtgtttacctatggtagcccctcccctaagtcagcacagcttggcatgattaggagaaaatgacgaaatcatagcttctctcttgaaaggaaaaaagaatggaatatattaggttggtgccattactttccatggcaaaaaccactgttattttataccacctaatatgtctaccattctagcctttcagggggcttccagaaaaggattggtttgcctcgcctgaactaaatcattgatgggttaatggcaaatttccttgggttgcagagaacaaaagtgaccttggcagcttgttgcagtgccaaagaacctgcagcacttcaaacagataccagagaaagcaagagaaaacaagctcctgaaaaaggaataagcaaacctctttaattatgaaattatatgcacaagcccagagaaaatgtatagccagaagagggttgaaagggccccagtatctctagcctggtttattggtgaaggtctttccctgtataaagccagtccataaagactgggagaggtggttgttttttcaaatgccaaaattacaggaaaaaaaaaaatacaaggcataggaagaaacaggaaaacattgcccaattaaagaaccaaagtaaatctccagaaactgatcataaagaaatagagatctatgaatttctagactaaaaatgcaaaataattgtctttaaaagctcaatgaaatccaagacaacacagaaaactaacaaaaattagaaaaatgaggcatgagcaaaatgagaatatcaacagagatagaaactctttaaaagaatcaagctgaaattctggagctaaaaaatacaataactgaattgaaaaacttgctagaggacttcagcagactagatcaagccgaaaaaagaagtcagtaaacttgaaaacattcatttgaaattatcacatcaaaggaacaaaaaacctgaagaaaagggaagaaggtctaagggacttatgggacaccatacaaaggatcaatttatgaaatatgggcgtctcagaaggagaagatcaagagaaaaaggagcagtgagattatttggagaaataatggctgaaaacttcccaaatctaagaaagaaaatggctgaaaacttcccaaatctaagacagaaaattctaaaagctcaaagagttccacctaggatgaaactaaagagatccacagtgagagacattataatcactatcaaaagtcaaagagagaatcttgaaagcagcaagagaaacaactcatcaagtacaagagagctcccataagatcatcagcaggtttctcaggagaaacctaggccagaaaggagtgagattatgtattcaaagtgaaaaaaaattctgccaaccaggaacactacatcccacaaatgtccttggaaaatgacagaaaaataaagacctttacatataaacaaaatctgataaacttcatcatcactatatctgccttacaagaaatgctaaagagagtctttcacattgaaacaaaaggaagctacgtaccaacacaaaactatacagaaatatgaagctctctggtaaaagtaaatacagccagccctccatatccatgggttctgcatccatggattcaaccaattgtggatcaaaaatattcagaaaaatggccaggtgcagtggctcacgcctgtaatcccagcactttgggaggctgaggcaggaggatcacttgaggtcaggagttccagagcagcctggccaacatggtgaaacctgtctcttctaaaaatacaaaaatgactcaggcatgttggcgcgcacctatagtcccagctactcaggaggctgagacaagagaatcacttgaacctgggaggtggagattgcagtgagctgagatcatgccactgcactcaaggctgggtgacagtgagactccacctcaaaaaaaaaaaaaaattcagaaaaaaaatcccaggccacacacagtggttcacacctataatctcagcatgttggaagactgaggcaggaggattgcttgagcccaagagttcaaggctagcctaggcaacaaattgagaacctggagaatgctctgtatgcacttgagaagaatgtgattaataaggaaacagaggacttgaatgctgcagaacaactggacctagaagacttgtacaaaacactccaagcaaaacagcagaatacacatccttctaaagggcatacagaacattctccagggcaaatcacatattaggccacaaaacaagttttaaaaaatgtaagaaagtatcttttccaactacagtgaaataaaactagaaatcaatagcagaaacactggaaaatcataaacacgtgaaaatttaaaaacagactcctgaacaaataataggtcaaagagcaatacataagggaaggtagaaaatacctcatgacaaatgaaaacaaaaatgcatattaaaacctatgggatgcagcaaaggaagtcctaagaaggaaatttataatagtataaattatatacaaaaagaagaaaaatctcaaattaacaacctgactttacacctcaaggaatgaaaaaaaaaaaaagaagtaaataaaatcaaagttaaaagaaggaaataagacacattggagaagaaataaaaagaaagtagaaaacaatgaacacatcaataaaactgagggttagctttttgaaaagatcaacaaattgacaaatacttttgagatagactaatgaacaaaagaaaaacactcaataaaaacagaaatgaaagatgagacattgcaactgataccacagaaataaaaagcatcaaaagagactgctatgaaacaattgaacgattataggccaacaaattagaaaaaatgcagagattcctaataacatatacctaccaagattaaatatgaagaaattaaaaatctgaacaaacctataattggtaaccagattgaatacataatcaaaaacctcccaacaaagagaaactcatgaccagatggcttcactgaagacttctgccaaacatttaaaaaagaattaacaccaatctttctcaaactattccaaaaattgaagggaatatttccaaatttatttttatgaggccagaattatcctgatatcaaacccagacaaagatactaaaagaaaacaacagagcattattgctgataaatattgattcaataatcctcaacaaaatactaccgaatcaaattcagcagcattttaaaaggattatattccatgaccaagtgggatttattcctgacatctaaggaagattttatatataaaaatcaacaactgggatacaccacattaacagaatgaaggacagaaagcacatgatcatctccattgatgtagaaaagcatttgacaaaatttgacacactttcataataaaaacactcaataaactagtaataaaaggaaattacctcaacataataaatgtcatatataaaaaaatcaacaacagctaacatcatactcaacattaaaaaaaaaatttactctaagatcaggaaccagacaagaatgcctactctggccaaatctattcaacatagtactgaatgtactagccagagctattaagcaagaaaaataaataaaaggcattaaattggaaatgaagaagtaaaattatacctgtttgcagatgacatgatcttgtatgtacaaaaccctaaagattccacacacaaaaaactgttagaataaggctgggcacagtggctcatgcctgtaatcccagcactttgggaggctgaggcaggaggattgcttgagcccaggagttgaagaccagcctaggcaacatagacagcttcatctctacaaataatttaaaaattagacaggcatggtgacatacatctgtggtcccagctgctaaggaggctcaggtgagaggcctgcttgcacctggacaattgaggctaaaatgagctgtgatcatgccactgcactccagcctgggaaacagagtgggattctgtcttaaaaaagaaaaaaaaacttgttagaataaacaaattcagcaaagttgcggaacataaaatcaacatgcagaaataagttgtgtttctatacactaacaacaaaaaatctaaaaattctgcaactcaaaatgaaacaaaataaatatcttgattgagaaatgagcaaaggacttgtatagacatttctccaaagaagaaatgaaatggccaataaacatatgaaaatattttcaacatcactaatcattaagtaaaagcaaatcaagaccacaatgagataccattttatactcattattaggatggctatttaaaaaatagaaaacaagtgtgggcaaggttgtacataaattaaaaccctgtgtggtgtttggtgggaatggtgtagctctatggaacacagtatggagtcccctttaaaaattaaaatagaattaccatataatccagcaatcccatgtctgagtatatacgtaacaggattggaaactggatctcaaggagatatttgcacatcattgtttgatgtagcattatttataacagccaaagagtcaatgcccatcaaaaaatgactgaataaagaaaatgtgttatacgcataaaatgaaatattattcatctttaaaagagaaggaaatcctgcaatatacaacatggatgaaccttgagaacattatgatgagtgaaataaaccattcacatgaagataaatactgcatgatttcatttgtataaggaatctaaggttgtcaaactctcagaaacagaatgtagactcgtggttgccaggggttgggtggcgagggggtgaagggaatagttcaaacactatagagtttcaggttttcaagatgaagaaatttcagaagtctgtcacacaacaatgtgcatatagttaaccctaatgtactttacagttaaaaagagttaaaatggtacattttacgtcgatgttttaccacagttaaaagttatggcactgatatagttcctgatatgaaaataagttaaaagtacaaaccataaatagcataagtggaataatctcactttttaacaaagcaggtaggtagtaggtataagaatacagcatagacataagagggagagagagaggtgctatgtctttgtagtggttaatgtatctccattagccctttattcacaagctctttccacacatataaacaacactcaagtctccttttcatttttttaaattctcaaattcatgatccccaatgaattatcctgtctctctccttttcctcaaaaaaagccgagcttctagaaaaagtaatatatattcacgttcagcaccccatcgtctctcattgactttttggtgatgtagtttccgtgtcctccaccctacagaaacaagtctttcctcaggcaacccttctgaatccctgacactgataattctgcttattctgcttgtgttactctcgtctccgctggttttccttcattcctctttaagtcacaccatttcagttgcctttcaaagtgtgctttttaaacgcctccatcttgaatgttggtgtttcccagggctctatccttgaccattgagaagacacttggcatttttatggctaatctttctcccctatgatttgaacctagccagtttcccagtatatattctgaaaatgcaagaagcttgcttccctaaggtccctggaagccaagtcatgatcacataatctgggctctggcgatcatggtatcaattggaaactctgctgagtattcccatttacccttctggatccactttccagccttttctaccctgctgtgtgcccagaaaactaactttcagacaccacatcccctggaactcctttgccagttgcctcctcattgcatttggccagtaagaaacactggcaggagatcagaggccaaaggagaatgaggttgaggtatctattcctctacttcttcctttctgtgatggctgcattcctgtatgtaaggccacagcccctctcctttagcactagatcttgttagactcctataattgctcgcttgcttgccccttcagacctaggggtgataaagacttatccctctttttatctcctatatggtcatcatctcttcttattccttcgaaaataatcctttcttaaaactctctttgacagccacttggagcccaccatctatttcctgtctgaaccctttctgataaagaaagtagtaacagaatgaagcaggaaccttgctaaatccatcctagtaaaaaaaaattggtttatggttggtagagtctttgatactagcagcaatgggttctgcagcaagctagccatctggcataatttgggaaacttatcttggctatgtaacctccacacttaatcctcctgccctcctggaaattatggtaaatcagccagagcttcatatcaaattctatttcttggaattaaaactctgactgatatagccttcttctttcctctaatgatagtttttattcatctctctctttcattcattaatctctttcattcccttccttcattttgtccttcctccctcccttcctctatttactttaattgaagtctatgcacttatagctcctaaatacttttctctactccaaatttccggacctccaatactatcgagtaagctccctactagacatcaccatatttccatgtaagtaccacataagctccttaaatccaatatttaaaaccctttttttattatactttaagttctagggtacataaaaccctgtcttattatttcctaccctaactctcttcctcttcagccacgtaacctactactttgcctcatctgcatggacaattacactatctaattatttatctgaatgagaaacccctagttttcctagactcttctatttcatatggcctgattgtttttcccaggtttgtcagagatcagatggttgtagatgtgtggcattatttctgaggcttctgttctgttccattggtctatatatctgttttggtaccagtaccatgctgttttggttactgtagccttgtagcataccttaaagtcaggtagcgtgatgcctccagctttgttatttttgtttagaattgccttggcaatatgggctcttttttggttccatatgaaatttaaagcagtttttttctaattctgtgaagaaagtcaatggtagcttaatggggatagcactgaatctataaattacttttggcagtgtggccattttcatgatattgattcttcctatccatgagcatggaatgtttttccatttgtttgtgtcctctcttatttccttgagaagtggtttgtagttctccttaaagaggtccttcgcatcccttgtaagttttattcctaggtattttattctttttgtagcagttgtgaatgggagttcactcatgatttggctctctgtttgtctattattggtgtataggaatacttgtgatttttgcacattgattttgtatcctgagactttgctgaagttgcttatcagcttaaggagatttgtggctgagatgatgtggttttctaaatatacaatcatgtcatctgcaaacagagacaatttgactttctctcttcctatctaaataccctttatttctttctattgcctgattgccctggccaaaacttccaatactgttgaataggagtggtgaaagagggcatccttgtcttgtgccagttttcaaagggaatgcttccagtttttgcccattgagtatgatattggctgtgggtttgtcataaatagctcttattattttgagataggtttcatcaatacctagtttattgagagttttaagcatgaaggggtgttgaattttatcaaaggccttttctgcatctattgagataatcatgtggtttttgttattgattctgtttatgtgatggattacatttattgatttgcatatgttgaaccagacttacatccagggatgaagctgacttcgtcgtggtggatacgctttttgatgcactgctggattttattgaggatttttgcatcaatgttcatcagggatagtggcctgaaattttcttttttctttttttttgtttttttttttgttgttgttgttgtggtggcggtggtggtggtggtgtctctgccaggttttgatatcaaaatgatgctggcctcataaaatgagttagttaggtgtccctctttttccattgtttggaatagtttcataaggaatggtaccagctcctctttgtacctctggtagaattcagctgtgaatccgtctggtcctgggcttttttttagttgataggctattaatcactgcctcaatttcagaacttgttattggtctattcagggattcgacttcttcctggtttagtcttgggagggtgtatgtgtcaaggaatttatccatttcttctagattttctagtttatttgtgtagaggtgtttgtagtattctctgatggtagtttgtatttctgtgggatcggtggtgatatcccctttatcattttttactgtgtctatttcattcttctctcttttcttctttattaatctggctatccgtctatctattttgttgatcttttcaaaaaaccagctcctggattcattgattttcttaagggtttttttgtgtctctatctccatcagttctgctctggtcttagttatttcttgtcttctgctagcttttgaatttgtttgctcttccttctctagttcttctaattgtgatcttagggtgccgattttagatctttcccgctttctcctgtgggcatttagtgctatagatttccctctaaaactgctttagctgtgtcccagagattctggtaagttgtgtctttgttctcattggtttcaaagaacttctttatttctgccttaatttcattctttacccagtagtcattcaggagcaagttgttcagtttccatgtagttgtgtggttttgagtgagtttcttaatcctgagttctaatttgattgcactatggtctgagagactattatgatttccattcttttgcatttgctgaggagtgttttacttccaattatgtggtcaattttagaataagtgcaatgtggtgctgaaaagaatgtatattctgttgatttggggtggagagttctgtagatgtctcttagatccacttggcccagagctaagttcaagtcctgaatatccttgttaattttctgtctcgtcgatctgtctaatattgacagtgaggtgttaaagtctcccactattattgtgtgggggtctaagtctctttttaggtctcttaataacctgctgtatgaatctgtgtgctcctgtattgcgtgcatatatatttaggatagttacctcttcctgttgcattgatccctttaccattatgtaatacccttctttgtcttttttttttttatcagtgttggcttaaagtctgttttatcagagactaggatagcaacctctgcttttttttttttttttttttttgctttccatttacttggtaaatattccaccatccctttattttgagcctgtgtgtgtctttgcacgtgagatgtgtttcctgaatacagcacaccaatgggtcttgactctttattcaatttgccagtctgtgtcttttaattggggcatttagcccatttacatttaaagttaatgttattatgtataaatttgatcctgtcattatgatgttagctggttattttgcctgctagttgatgcatttcttcatagtgtcaatgatctttccaatttggtatgtttttgctgtgtctggtactggtttttcctttccagatttagtgcttccttcagaagctcttgtaaggcaggcctggtgttgacaaaatctctcagaatttgcttgtctgtaaaggattttctttctcctttgcttatgaagcttagtttggctggatatgaaattctgggttgaaaattcttttctttcagaaggttgaatattggcccccactctcttctggctttgtagagtttctgcagagatcttctgttagtctgattggcttccctttgtgggtaacccgacctttctctctgcctgcccttaacattttttccttcatttcaactttgatgaatctgatggttatgtgtcttggagttgctcttctggaggagtatcactgtggtgttctctgtatttcctgaatgtaaatgttggcgtgtcttgctagactggggaagttctcccgaataatatcctgaagagcgctttccaacttggttccattctccccatcttgtcttcacactttatttcattaagttgatattcaatctctgatatcctttcttccgcttgatcgattcatctattgatacttgtgtatacttcatgaagttcttgtgctgtgtttttcagctccatcaggtcatttatgttctctaaactggttattccagttagtacttcgtctaatcttttttcaaggttcttagcttccttgcattgggttagaacatgctcctttagctcagaggagtttgttattacccatcttccaaagcctacttctgtcaatttgtcaaactcattctccatccagttttgatcccttgctggtaaggagctgtgatcctttggaaaagaggtttttggaattttcagcctttttgccttggtttttcctcatcttattggatttatctacctttggtctttgatgttggtgacttttgaatggggtttttgagtggacatcctttttgttgattttgatactattcctttctgtttgttagttttccttctaacagtcaggcccctctggtgcgggtctgctggagtttgctggaggtccactccagaccctgtttgcctgggtatcaccagcggaggctgcagaacagcaaagattgctgccagttccttcctctgggagctacgttccagaggggcacccaccacatgccagccagagctctgtgtgaggtgtctgttgacccctgctgggaggttctcccagtcaggaggcacagggttcagggacccccttgaggaggcagtctatctcttagtagagctcaagcgctgtgctaggagatccactgctctcttcagagccggcaggcaggaatgtttaattctgctgaagctgcacccacagctgccccttcccacaggtgctctgccaagggagatgggagttttatctataagcccctgactggggctgctgcctttgtttcagagatgccctgcccagagaggaggaatatagagaggcagtctggctacagtggttttgccaagctgtggtgggctccacccagttcgaacttccaggcggctttgtttacaatctgaggggaaaactgcctactcaagcctcactaatggtggacatgcctcctcccaccaagctcgagcatcccaggtcgactacagactatagactgctgggctggcagtgagaatttcaagccagtacatcttagcttgctgggctctgtggaggtggaatccacttagctagaccacttggctccctggcttcagcaccctttccagggcagtaaatggctctgtcttgctgacattccaggcgccactggggtatgaaaaaaaaaaaaaactcctgcagctagcttggtgtctgcccaaaaagacgcccacttttgtgcttgaaacccatggccctggtagtgtaggcacctgagggaatctcctggtctgcaggttgtgaagaccatgggaaaagcatagtatctgggtgggaatgcaccgttccacgagatacagtccctcacggcttccgttggctaggggagggagttcctcaaccctttgcacttcccaggtgatgcgatgccccaccctgcttcggctcaccctccgtgggctgcacctactgtctaaccagccccaatgagatgagccaggtacctcagttggaaatgcagaaatcactcgccttctgcgttggtctcgctgggagctgcagaccggagctgttcccattcagccatcttcccagccaccattaatgtcttacgtaaggctttgcatgacctagccttcctcacctctccagtctcatttgctagaaacatcatccaaggctcagccagatcacaaaaggctcaacatatcttccccaccttcatgctacatatcatagagatacattgtgtttcctcaatctcaaatacctatcgcccagttagatactgtctaacatccaattctccttcaagagtcatatgtcatcttctcctgaccacccccatcttacagatggcccatgtctgtgtaccccaggaattcttctatcatagaatttatgatagaagaattttcagtttacttgtctgtcttcacatctagattttgaacacattaagagaaggcatagtgtctaaaacccagtaatatacttcatagatatttgtcacataaattacatttctcaatccaagttaaattataaaaactcaaaaatgcctgcttttgacaatgggaaaaaagtgccaagctacaactgctgcctctaaagagaggcatagagaaaggagcagaagcaaagtagaactagcacacactgaatgaaaacatggtagtagctctaatggggaagtttggggccctgacagactatagataaagccatttgggagcagggaaaatttcttggagccacttaaagcaacatcttttatatggtcacttgtgagaggttagccctgtcctaaggacaaatttgatttaatactccaaggttcacttatatacaagatcactcctccacatccaaagaggagaagggtaaatcatcatctgtgtcatctctgaaaagaaaggacaagaatgtattcttactgctggatgttccactaacttaaagaccttatgagaaatgtggcatgcctgtgtttttacgaggtcaaatggatgatctccagtgactaatgatggtgtcaactggcttccaaagattttttattttgtgaaaaatgattcaagcatgaggtccaaaagataccataaggatatttcaccaacatacattttcccaaaatactgaacacctttaaatagagtaggattttgttttgcaaacgttccaactgaattcaagcgaaaaatatttattcatttatctatccaattggtggacaaataattatcaagtataattatcaagtatttcttatgtactttgatgatgcagtatgaactgtagatataaatgaataaaatgcattccctaactttaaggaattcatagcccaaacggacaaggtatataaacaataacagtatataacaaatacagtggtgacataagcaaagtgttgtggggaattgttgggctgatagtattaacattcaaaatatcagctgttcctctctaggcatgtattatacttcctcatcctgttgactaacgacatatgatttattgtaggcagtgaaatatgagcagaactgacatgcaacgttctgagcaaagagccattgcttggtttcactatatttcattttccctatgcccattgatcagcagcatctcaaacaaagcctgctctgcaagcctgggcccaagagtaaaaatgattcagaggaaagacacagcagacctgaaatggatatgtaacatacatgagaaataaacttaagtctctgagattttgaagctgtgacggttaatattaggtgttaacttgactgaattgaaggatgcctacatagctggtaaaatattgtttctgggcatgtctgtgagggtgttgccagaagagactgacatttgagtcagtggactgggagaggaagacccaccatcaatgtgggtggcaccctccattcggctgccagcacggctagaacaaagcaggcagaagaaggtgggataagctagcttgctgagtctcctgactttcatcttcctcccgtgctggatgcttccttctgcccttggacatcagaatccagggtcttcagcctttggactgttggacttgcaccagtggtttgctgggggctctcaggcctttggccacagaccaaaatctgcactgttgggttccctgcttttgaggcttttggattctgactgagccactactggcctccctcttccccagctgtagacagcttgtagacagcttgtagacaccttgtgatcatgtgagccagttctccctagtaaactccctttcatatatacttatatcttatgagttctgtctctctggagaaccctgactaatacagaagccatgtgctactgcagtataacctagcccatactgactgaaatagttgttatgaagaaattaatcttgggtggggtacaagttaaagttatagaagaagtgacatattgagttggatcttgaaggctgagtaggagtagtgaggaaagggtttttagggcagagattctggtgtgagcaaagatctggtggtgtggaagtatatatcctatttagacaagttacccccgacacaggattatgaaatatatgctagtgttacatacgaaagacccattggtcatgccaagaaaaataaattttaccctcctgcttaggagtcacaaaaaggttttgaaggattctgagtttaaagtttgtagccaaaatcatgttgaaggcaattgaaaatagaaaagaaacatctaagacatctaaaggcctttattccctcaagtttagaaccccttacactgaaaagaggttaaatgatacacccacaaagtagtggaggttgaaatggagcccaaacagcctgcaggacacgtgactcagctcaaaagagaataacaatagagggaaacaatagtaagtggctactactgtaccatttccagaaaaaaaagagcctctgggcgcattgtgagctttcaaaacactctagacttggctctgagtgcagaccaaaggaagaaaataaaaacaaggcagagggacttacaggcacagtaaaaagaagcttgtgctgtatgccaggctttagtcttggtaataattctttcttttcttgttctattttatttcttgataaaaactcattctaaagtagtccttaaaaccgtctggcttctcaccaagttttgactactgaattgagacagcttgttgctttttcttggcatattagattgattatacatgaaaacctatctgagatgttttctacaatgtctatccatcatatgaaggacttaatgtctctgtggttagacaaagataatacaagccatcttagaaggtatgctgtataggttgcccacgaaataaacaaacaaacaaactggaattcaacatggctgcccaaggtcaacctagactacttaatgaagttcagccatagactagctaccatttttcgtagagaattgtttcctctttggagcaatgcttatcgtatataaactttgtaatcagtctcttcacattcttttaaatatctcattggctatatattggcctttccaaaacaatcaagtgtcctactgtgagttctcaacattactaatggacattgaagagacagttttacaataaagttttgaaggcttaacactggaattaggagctattcagtatagcatcttcagggtcagggcattctctgaaaaaaacataggatcctacaagatagaaaaccctacttcactctcctctctatctaatttctactctttttttcttttcttttaaaattttattgcagtaagaacacttaatataaggtctaccctcttaacagatttttaagtacatgcaaaacaggcacaacgccatacagcagatctccagaacttattcatcttgaaactcttttttttttttttttttttttttttttttttttttttttgagacggagtctccctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggccgaaactctttacctgatgatttagcatctccatttcctcttccctcaacccccggcaaccaccattctattctctgcttcttacgagtttgacaattttagatacttcatataagtgcaataatgcggtaattatcttactacgaattgcttatttcatttagcataatgtcctcaagttccatccatgttgttgcatattggaagatttcctttcttaagactaaataatactccaatgtacgtatataccactttttttacccaatcataaacaaacatttaggttgtttccattttggcctattgtgaatagtgctgcagtgaatatgggagtgctaatatctcttcaagatcctgatttcaatacttttggtaaaatactcagaagtgagatggctagctcatataatagttctcttttctaatattatgaggaaccttcatactattttccatagaggctgcaccattttgcattcctactaacagtgtacatgtgttccaatttccccacaacccgatcacacttggtcttttgtgtttttgataatagccattctaacaagtatgaggtgctatctcattgtggtttcgatttacatttccctaatcattggtgacattaagcatgtttttatacacctgttagtcatctgtatgtcttctttggagaaatgccccactctgcttcggctcaccctccttgggctgcacccactatctaatcagtcccaatgagatgagccgggtacctcagttggaaatgcagaaatcacttgctttctgcgttgatctcactgggagctgcagacaggagctgttcctattcggccatcttgccggccaccccattggttctctttctctggagaaccttgactaacatatactttttacctggtattcacaccatcgtctctatgattcaacatagaatggtgattctgtctccttgaacatagttgatggaaccatggactatgtacctgacctgtggcttggcttaaaaattttttgttcgtctatcaggtctattctcttgggaatccaaactgagaaaataaagcaattggcatcaggaactgtgactgaaagaatgtatatagagacgtctcatgatttacaatcagcagccaggaggcctcgtggcaggctagattttaaggaagcagatactctgagagctacagagaaaccataagcaagagatcatgtagcctgtgtgagaggagataacagccaatccctagatttttcttggcttctaatgtttttcctgtaccagtgcctgtgtatcctcacaacaaactccacttcgcaaggcttcttgtgtgatttcctgtttctcacaacctgtggagcccagttagaacttggcacagtcttcagaggcctccatgactgctcatatttttaggaaatatgctttcatcagttccctaacacagcttatatttctcttacaaggcctccaacattaataataaaaaagagaaataaaatgatcgaaaagaaaggaaatgcctcaaatgaaaccaactcatgggaaaacactagatataactggattaatccattctttaaaaataagcagttgctctccgtggtttttctttggccaaatttaaaggccaggagaagtttgaacatacctctggactatgtaaatatctctctttctttacattaggatacccacagtggaaaggctccgtatggaaacagtgctaaatgcatctcaggtgggcttttccaagaagtgttacaacagtatttcctcaaaggaggcatatagaagcacatatgaagggagagaactgtctcccaataggatagcagagacagaaggcaaaagaggcactaagtcagacaaccgttctgtatttgttttaatgaggagaagaggaaaatgtgcccagagcagctatataagactgacggtgagcaattaaactgtctataacgtttttggtattgctgttataagaagcttctaaaatggatgagacaccagaatcagtcagcctgcttacatgctgagtcaaaaaaatagaaatcccttggggagatttgagcacttgcttggttctggcggaagtgctgctgattgaaaagtggcaggtggcatgttctccttgggataaatgcccttttgagtcaattggcaggcacctcaggggcccatgtttgaatgaagctgaagggacacttgggccatttttcctcctgtcttattaccagaaatacaaatttaggtaaatgacatggagtagtatttctcagttcttttttccaaatgatttccctttttaccaagcataaatatctcatgcccttttctaatgttattggaaatttcaaaataaattaaaatctgatgtaaaacaaatcattgtaatgggactaaagattactttcacactaagcatttattcttttaacgtcactaaacaggatatgaaagttatcaagttttaacctaaattttaaagtcaaagttatgcagttactcaagtttcttgaatgataaacatattctgtagctctcatgtgtattcctctctctcccccatatatatacaaacacacacacacacacacacacatatatgttttcttaatgttgagctagatgctgtgaccagtttatacctataaaagagcacaaaaatatttgttgttaatatatttgtgagacaagactttcacacctaacatctaagttggctatcattgcagagttatgatactatgttgaattatagagacgatagtgtgaataccaggtaaaatgtatgtgttagtcaagtttctccagagaaagagaaccagtggggtggctggcaagatggccgaataggaacagctccggtccgcagctcccagtgagatcaacacagaaggcagatgatttctgcatttccaactgaggtacccagctctctatatacattctttcagtctcagttcctgatgccaattactttattttctcagtttggattcccaagggaatagacctgatagaccaacaaaaaaatttaagccaagccacaggtcaggtacatagtccatggttccaccaactatgttccaggagatggaatcacctgatctgtgtaagactatccctcctgaactggtaatgagtagatgttttctcttaaaaggaatttcaaacagataagaacagatactacacttgatcttagccaaatgctggtggcatcatgctacctgacttcaaactatattacaaggctacaggaacaaaacagcatggtactggtaccaaaacagatatatagacaaatggaacagaacagaggcctcagaagtaacaccacacatctgctaccatctcacctttgacaaacctgacaaaaacaagaaatggggaaaggattccctatttaataaatggtgttggggaaactggctagcaatatgcagaaaactgaaattggaccccttccttataccttatacaaaatttaactcaagatggattaaagacttacatgttagacctaaaaccataaaaaccctagaagaaaacctaggcaataccattcaggacataggcatgggcaaacacttcatgactaaaacaccaaaagcaatggcaacaaaagccaaaatagacaaatgggatctaattaaactaaagagcttctgcacagcaaaagaaactatcatcagagtgaacagtcaacctacagaatgggagaaaaattttgcaatctatccatctgacaaagggataatatccagaatctacaacgaacttaaacaaatttagaagaaaaacaaataaccccatcaaaaagtggacaagggataggaacagacacttctaaaaagaagacatttatgtggccaacaaacatatgaaaaaaagctcatcatcactggtcattagagaaatgcaaatcaaaaccacaatgagacaccatctcacatcagttagaatggcgatcattaaaaagtcaggaaacaacagatgctggagaggatgtggaggaatagtaccacttttacagtgttggtgggagtgtaaattagttcaaccattgtggaacacagtgtggcgattcctaaaggatctagaaccagaaatactatttgacccagcaatctcattactgggtatatacccaaaggattataaatcattctactgtgaagacacatgcacacgtatgtttattgcagcactgttcacaatagcaaagacttggaacccacccgaatgcccatcaatgatagactggataaagaaaatgtggcacatatacaccatggaatactatgcagccataaaaaaggatgagtttgtgtcatttacagggacatggatgaagctggaaaccatcactcccagcaaactaacacaggaacagaaaaacgaacaccgtatgttctcactcataagtgggaattgaacaacgagaacacatggacacagggaggggaacatcacctgccagggactgtcgggaggtgaggggatggggagggagagcattaggagaaatacctaatgtagatgacgggttgatgggtgcagaaaaccaccatgtcacgtgtatacctacgtaacaaacctgcatgttctgcacatgtatcccagaacttaaagtataatttaaaaaaaaaaaatctagaaggaaaaaaaaggaacttcaagacacacttcagagaaaagtggcagagtaggcagctctcattttttttgtgcccaccgccaccccaacaaattaaacacaagcagaaactgtcaaaaccaactgtttcagaactggaaaacagtcaaaggtttacaacaatcaagcaaacactgaattaagaataaaagcaacttcaaaacagtaggaaagctttgggtcatttttatttgcctttattccaagtcttccctgccacaacaggagccttagcccacattcccagtgtaagactctgatcactggtgccaaaggaacagagcagaccttatttgcagattatcatttatgtctattctagcatgtctgtggcaggctattgataaaaggaacttatctctgtttcacctaactcagactcactaagaaaaagcaagaggcaccactcaaaaacactgcaagcccaactaaaaacccatcaacatctgggacaaaagattaatgttgcaatatataataaaatgtgtaaggcctgggagctaaagttgggaaaaatttctttggaaaattgggaaattcaacagcacctatgtatagcaaggaatttatgaagcaacataaatgccaagggtaagatgcatacttagaaaacacagagagaaccctaagttttcattttgggctgaatattggaatcagtgcaagcaagcctaaatacggaagtagaactccgaaacacaggtaatgtggaaaggctgagagatatgttttccatttgtgtgtattgttgttgtctttttgtttttgtttgtttgcttttagctccaggcactcaagaaatatctgtcaaatttagtatagtactaggattactagcaagaacaatcagacaagaagaaatgaaaaccatccaaatcaaatcaaaagaagtaacattttccctggttgcagatgacatgatcctatatgtagaaaatactaaagaatctgcaaaaataataatacatgaattcagcaaagtagaaagatacaaaatcaacatacaaaactcagtggcatttctttacaccaataataatctctatgaaaaaaaaaaaaccaagaaaacaatcccatatacaatacctaaaaaaataactgtttaggaataaatttaaccaagtaagtagaagatccatacactaaaaactataaaagactgattaaaaaaattgaagaagacacaaataaatgaaaagataagctatattcatggattggaagaaataatattgttaaagtgtccatactacccaagtgattcaagtgatctacaatttcaatgcaatccctaacaattatccaatggcattttcgacaaaaatacaaaaaaaaaaaaacaaaaaaaaaaaaccttttctaaagtgtgtatggaaccacaaaagacccctcctaaccaaaataatattaagacaaaaaagcaaatgaaggcatcatacttcctgatttcatcttatattacaaagctataataatcaaaacagtgtggtattggcataaacacagacaaagaccaaggggacagaataggaaccccagaaataaactcaagcctatatggtcaactaattttccacaagggcaccaagagtacacaatgggaaaaggacagtctctttaataaatggtaatgggaaaagcggatatccacaagcaaaaaaaaaaaaagacaagagaagaaactggaactttctttaaccccatacatcaacttgaaatgtattaaaagacctgaacataagacccaaaactgtaaaacaccaaacaaaaaattgagtggaaattcttcatgacattagcctgggtaatgattttttagatatcacgccaaaagttcaggtgagaaaatcaaaaatgaaccagttaaactatatcaaactaaaaagcttttccacagcaaaggagacaatcaacagaatgaaaaagtaacctacaaaataggagaacatatttgctagccatatacatataaacatataagaaattcagacaactcaataataaaaaaattaaaaatcagacaacagacctaaatagacctaaatttttacaaagcagatatacaaatggacaatgggtatatgaaaaggtgctcaacatcactaatcatcaaagaaatacaacaccatgagatattaactcataccgatttcggtgttagatggctactatcaaaaagacaagagatgtgttggtgagtatgtgaagaaaagggaactcttctacactgatgataataatgtaaattgttacagccattatgaaaaacagtatgaagcttcctcaacaaaattttcaaaaagagctacagtacgatacagcaattcctcttctgggtatgtacctaaaggaaatgaaatcagcacattgcagagctatctgcaactcaatgttcacggaagcattattaacactagccaatatataaaagcaaactaggtacccatcaacagatgattagataaataaatcatggcatatatacacaatgaatattattcagccttagaaaagaaagagatactgccatttgggatgacatggatgaacctgaaggacattatgctgggtgaaataagtgagacttagaaagacaaataatgtatgatctcacacttatttgactttttaagagagtcaaataaatacaaacgaagagtagaaaggtggatagcagaggtgaggagggaaggaaatgggaagaagtaggtcaaagtaggtcaaaattccacctaaccactttgcagttaggtggaacaaataatgtacaggataaggactatagttaataatattgtataactgaatattcatatacagaggaatgaaactggaccactctctctcaccatgtacaaaaatcaaaacaaaatggattgaagacttaaatataagacctcaatctattaagctactacaggaaaacattggggaaactctccaggaaataggactggacaaagatttcttgaataataccccgctagcacaggcaaccaaagcaaaaatggactaatgggattacatcaagttaaaatgattctgcacaggaaaagaaacaatcaacaaagtgcaaagacaacccaaagaatggaagaaattatttgaaaactactcatctcacaagggattgattaataaccagaatatataaggagctcaaacagctctgtaggaaaaaatctaatgatctgattttaaaatgggcaaaagattttaatagacatgtctcaaaagaagacatacaaatggcaatcaggtatacgaaaatgtgttcaacatcattggtcatcagagaaatgcaaatcaaaactacaataagatatcatctcactccagttaaaatgccttttatccaaaagtcaggcaataatgaaggctggcaaggatgtggagaaaagggaaaacttgtatgctattggtgggaatgtaaattagtgcaaccactatggagaacactatggagttcttcagaaaactaaaaataggactactatatgacccaacaatccaaaagaaaaaaaaatggtatatcaaagagatatctgcacgtccatgtttattgcagcactattcacaaaagcgaagattttaaaacatcaacatctgtgtccatcgacagatgactagataaagaaaaagtgttacatatgcacaagggagtactactctgctataaaaaagaatgagatcctgtcatttgcaacaacatggatggaactggagactattatgctaagtgaaataagccaggcatggaaagacaagatttgcatgttctcacttatttgtgggagctaaaaatgaaaacaattgaactcatggagatatagagtagaatgatggttaccagaggctgggaaggggaggggggagggggagggggaagtggagatgattaacggttacaaaacctatagaaagagtgaatgaggtctagtatttgctagcacaacagggtaactacagtcaataatttaattgtacatttaaaaataactaaaagagtgtaattggattgcttgtaacacaaaggataaatgcttgaggtgatggataccccatttaccctgatgtgattattacacattgtctgtatcaaaatatctcatgtatcccacaaatatatacacctactatgtacccataaaaattaaaaataataaaaagaaaagagaacaagctattgcctctgctcctaagcacctcacttgtcactgaggagacatgttaggtggtagcctttggtaaaagcttctctgtcagacctttaaagtgtcagactttagtctcctttccctgtaagttaatttttgctagcctagaataagtcagcctcagagaaagcctgtttgcctcagctgtttaccttgctgtttacctcactaatgtagattttctgtacggatgcaaatcttctccacaaaagacagcctttcagaagtattcctgtggtttgcagcccctctgaatagacatatggaaatatgccaaagaaggatattttggggtaaaatattctggtttacttcaatagcaataaacgcctacattgacaacaagaaagagcccgaataaacaacctcacattatgccccaagaagctagaaaaagaacaaataaaacctgaaaaatctaataaaaattagcaaatgaaggggaaaggagcattaaaataataaatctaaaaatatattatctcgagtaaagacatattgctaaagaatgtgtataaaattcaagtaaggctcgaagcatgcaaataataccatatattgtctatactatatattacttgcatataataaaaatttgtaaaaacatgctcagaattgaaacacatcaaatacagcagaggaggtgtgcaatcaggttttcactctttaaaaactacatttgactgatactgaagttgggtgatgagatattgaatgcattgggtgcattattctctcctctttgggttctgtttaaaaattttgatgatagagttactatacagaacaaacaactataaaaaatcaaaaaaactttaagacaactggaaaattttaattacagtctgggtattagataatattaagaacattttactaattcttcaggtacaataatagtgaaactgcctttgcaaaaattatagctgaggaaattatgacagtgaaagagatctgacctaaccaactccatcttgctttcaaccttgaagctgtcttttctcattcctaggaatgggccaagctaactttgggagaaatttagtttatagtttaaatattagtccttccccacaactaaaatattcttgtaaaactaatgaaaggccaccaagtgaggatgggaggagcttgaattctacataattaccagcaattattccagaggtcataagatttgcaactttcccaattactactgaagataatatcactattgtagaatctaagattggccttttgagatgtcttttcacgtttttgcatttctgacaaccagatggctccacctggacctgccaaccagtccttgtggcccccacccaggaactgactcaacgtaagaggacagcatcaactccctatgatttcatctccgagccaacctatcagcactcccaacttactggtcccctatgcagcaaattattcgtaaaaactccgatcctcaaactctcagggagactgatttgagtaataagtctccagtctcctggacagccagctctgtgtgaattaaacactttctctattgcaatcccctgtattaataaattggccctgtctagacagcaggaaaggagaacccattgggttgtcacaatagcacaatggtcatgtgaatgaaacaaatgatctcagtaattcataccaaaatatttacaactgaacaacatcatgtctaggattttctttaaaaacattctggcaaaattttaagaaggggtagaggaggataggtgaaaattagattggcaattgttgctaattgttaaaactgaataaaggttacatgagtattcattataatatatatttcactttggtatatttaactttgtatacacaatattatattatactactacaggggctaagggaaaactccccctttgacctctgaaatttcactgaaaaattaactgataaaaggcagattaataggagaaatggcatacaaatgtattagcatgcacaggggagaatcgcagagtgattactcaatatctctcatagggcccagataattatatagcattatttcagaggggagcagggagatggggaatataggtaattctgttgaggggcaataagtgatttgctagggagaataagtggatcgaggaatggagattaacttgtaagagtttctcttagaaaactgaatgagcctgagagatagacactattttgtgagagggtctgttcagtcctggttacattcttggtcttttccacaataaataatgagacaacagggaatggaaggaagaacaattgttctccttggtgggtccttctggtttttatgcagataagggaaaagtttcttccagtgtctgttggtctctaagagcctttaattcaaattactcattttagcagggagccatattgggggatgaagatccctgcactccttcagtatattatattaaaatgttatgattggaaaaagctggaggtagatacacagatattcattatatttcttctttttatatgttggaaatactgtttaattttaaaaagggaaaaaacttatttaaaaaattgtatacattctccatataaaccttaccagtttctcacaaatatttctgtaatactgctctttaaaactcaaaaaagcctacatgtcctgcaacgtagattttttaaaaagacctttatctcagaaatgtcatatgttctagaaaaaccccaagaccttagaattcatttttaaactaaaatttcaaagatgcaggaggctcctaacctcgttttctctttgtatttccaaagatctgtcatgcccttttaatacaatgccttctttatcccccaaagaattcctgctgcttaacatctctgtgaaacccctatggtgctatgaagtaggggaaataaaatatgctccccttggaggaaaagtgtgtgtccataagaagtaacttacctcttggaggcaaaacacacccatttcactcccagaagaagattgtatgctttgtcctgtcaaaatgtaggactgtgtatggggaaggtggagagggagataaaatttgagaagttaatgaatcaggaggcatggaatattagaaaaagcaccgggactggagccagctccaccatgtattagctgcatagtcttggacaagctgttttagtgtctctacatttcagagaagttgtaataggtttatatcagtggtctttaatcctgactgcaccttagaattcctggagatctttttaaaacttctaatgcctgggccctaccccattcaaaaatccctgggatacatctgaagcaaggaccatccttaatgctcctcaggtgattctaagctgcagccagggtggtgacccactggttttgtaactgtccagtggattcattttgcccactgcccaaatagagctgatttatcaagacacaggaattgcaatagagaaagaatttaattcatgcagagccgactgaatgggagaccagagttttattattactcaaatcagtttcctaatctcagatactagggtttttcaagcatagtttgacggtagggggcaagggagtggtgagttctgactggttgggtcagagattatatcacaggaagtcctcttgagctgagtcagttcctggatgggggccacaggaacagctggcaggcccaggtggagccatcggtggtcagaaatggaaaaacctgaaaagatatctcaaaaggccagtcttaggttctacaatagtgatattatctgcaggagtaattggggaagttgcaaatcttgtggctaatttgttagtcttacaaaggcaatctggtccccaggcaagaagggagtttgttttgcgaaagggctgttatcatcaaagttaaactataaactacattcctctcaaagttagtttggcctgtgcccaggaatgaacaagggcagcttgaaggttagaagcaggatggaattggttagatcagacctatgaactatcataactttctcactgttattatttttgcaaaagtggtttcagtctagatcttgaaggtcccctccagcttatcattctacttggatatacctgtaggaaactgtggtagctataatttttgccttcctaacatgcttcttccatagcttcttccagtcataaccaccttctgttggaaaacatgttctatgtagttctgtggggttaatgcctccctcatctgacattcagcactattccagttttattatactaactacaatatatactgtagcaggacaagccgcagacaaaactcctcagatatcgagttaaagaaggaagaggtttatttggccgggagcatcggcaagactcctctatcaagagctgagatcttcgagtgagcaattcccgtcccttttaagggctaacaactctaagggggtccacgtgagagggtcgtgatccattgagcaagcagcgagtacatgacaggggctgcatgcaccggtggtcagagtgaaacagaacagaccgggaagtttcacaatgtctttctacaatctatagataaaatcagttgctaggtcaggggtcaaattttaactaccaggctcaggtcaggcaggcccaggcctggtttcgggcctggttccttggtttcgggtctggttcccaggcgccagactacctgccttttagttttgcttctctttccttttctgagtataaaacaatataaaacaacatgagagggtctgtctctcttctctcaataccataaagaacaatcaagcaatagttatagctgtacccaatgaacactaaaaatcttaagagttcacagcctgaaggacccaaataaaacaacctaagatcatagttttttgtttgatttttttctgaattgggcaagaaacatataaagatatattcagtgatcaaatccctaagattctataaagctctatttatgacaattgcctgctccacaaaacccctaaacttttttctgttaaagaacatttacagagtgggcattcaaacccagaaaatctgaatccagaacctctactctgaactacaagcccatatcatcccagaataatgggatatgctatttatttgccttgggattaatagagggtaaataaccctttcagaatcattactggtgatataaaaaatttagctatgctcctcaatttaaaatattgcattacattttaaattactgtatttaaaaacaaaatgttaccatctggatattcctttaacttctacaagtagggaaaactcatatttaagtcatttgtcctcaggccacttttgtcttaaaggtctaatctatctcggctgggtgcggtggctcacgcctgtaatcccagcactttgggaggccaaggtggggggatcacctgaggtcgggagttcgagaccagcctgaccaacatggagaaacctcgtctctactaaaaatacacaattagccaggcatggtggtgcatgcctgtaatcccagctactcgggaggctgaggcagaaaaatcgcttgaacccagggggtggaggttgcagtgagccgagatggcgccattgcactccagcctgggcaacaagagcgaaactccgtctcaaaaaaaaaaaaaagaaaaaaaaagttctaatctatctgccataaatttaccctccaagtccagataacctatggctcagtttgtctcactccctctgaccacttcggtaaacacttgagaccaggaaaggaaatatactagatgctgtatttagcttcagaactataaatttcttgtggttatgtgaagtgataacatttgtggaagctgagtgaaggatataatggaattctttgtattatttttgtaacttttgctaagtctgaaattatttcaaaatgaaaaaatatttaatttaacatcatgtagtcattctaataaaaacactttgacacaactgtttagggggaaatagcaaaaaaaaaaaaaaaaaaaaaaaaaaattaaaaaggccagagctacatttttaacataaaattgaaagttatatgaaaggtacataaaactatgtgtaaccagacttgtttttattcactattcacatcagagaagacttgagggaatggttacttcagaattaatctgtaatagatcactctctagacattttctacatttgtttccccttcagtttcagtgtcatctaatcccttcaccatgtatataaagctttagataaagaaaggaaacattagagaaatactagatagacacccatgatgaagttgaggcaaaaatgtctcaagaggaccagcagaaggagtggaagataaagaagaaaaaagaaagtcagtgcacttggtcccaaagttgagggaaaaaaaaaaagatgttgctgccctctattcctccctccttcctagcccccaattaactcatcattcctaaaatgctctcataaaattctaaccaaattcaatgtggctaatagttttcatttcctaccaactgctaggaaaatgtggtccctcagtgaaaacatcaacaaatctcttaatcttgtaaaaaaattaatcttgtaaaaagagaatgtaaaatgtttccagtttgagacctgtcctcataaaacacaccttttttaacctctttagagaaagtaaactcagttgggggtataaataaacaatggtttcaaccttgaaagagggactattgcataaattaaataaaccttaaaattaatttcaaaattaaataaaaagtatgctcttttctaaataaatcaaatcagtactttgttaatctgtttaaattattactttccttagtgaagagaaactagacatttcaaacctggtcatggatcctattcctaactgtcatatctccacaagcaggaagatgctaattaaacaaactcaaggagcactttggaacccactcttcacttttcagtctttatcagttgaagatgtcatattttggaaatttacatttccatcatacattatgtttaatactaagttcatttttgcaaaatggccagtagatgacaagctttgacataatttgcagatcactgaaaggactttccccctcattcctctcagtgttgtcttttggtatgattgcgtctccatgatgagggaagggactcatctaagccaagatgggtggcagcatttaatgtatccatggtccctgccaagaaaagccatgaacacaaaaatgtcattcagaccagaggcctgaaaagagatggaaaacctctaacagtctaaggaatagacctaggaaaataaaaaggctcttgtctaggcctaagtaaataccaaatatactttataaaaagagcaatgatccagaaatgagatctaggttctggcctaggctctgctactagttggataagttgtattgaggaaattttgcattcatttttaaagggttgatatatcttcttaaggtcatttgtggagcttaggacaacaatcgtgaagttagataaatttcaaggtatatatccaacattagcattctgtgacagtatgagactatacaaacctttgaagcatattactaaataataccagactcttattagagtaggtttggacctgaggtttgaaagcctaaaccaaacaattttcaccagtgttgggactcagaaaacaatacctcaaaatgaaagccccagaagcagtctcagaagcaaaagcttttctctgaccttttcctgcccatctgtctctcagtcttatttgcctccagggctagccattgaaactaatatctctcttacccaaggcaagttacagaaatcagaaccccttttttccaaagctagtcataaacctaaaaatattactctaatttttccttttcctctttatataaaaactagctattaacaattatctgaactaccttaggaaggaatgcgtgccctgagagatcaagaaaaatcgagacagacaaaccttgatgggttcccccattcaatcttttatcattaggtcatactctttccctccaatcatatttggacatggctgtccataccttgttgaactgaaaaatgggcaattttacctttacctttgggtcttcattctgaaggctgccacatatacatgttacataaatttatatgccttttctcctattaatctgcctcatgtcagtgatttttcagtgaacttttaggagggcaatgactttagctcccacagttttggtgctatgtgcagggtcaccaaagctgctctgctcttccgaaagccaccgtaaaaaaaatccagaacttgatcagctggtaatagggtaaaaatctcttcccagtcaggctctcaacctctttctctgtgcaatctggttgaacagatgatataaatcactgttcgtctcctgtgagattttaattaatgggaaaaaatcattatgactagtcttggggttccagtgcctagtctctggtgtactttttgatactttctggttataaatattcatattgtttaatccatttcctcccagaaatagtcttttcctttgtctttttctttctgtattgttctgtcataaagaggggtaccagataaagttccttcttctctagttttatgtccttgagaatttgacttgcgatcaagtgggggaactctcttgatcttcaccatatggggccatgatttttgggtgacatcaggtgaccagtctaaaaatggctgggaacacaagattttttttgttccaaatgtgccaagccctcaggagggtttgtcatacaatgtcccatccataaggagcttttgtcttctcaacccttattgcctagttaatactaaaaaagtccaatcccaggagggcctacccagtgtcacagattaagggacctgtgactggcagtccccccacacaaatctgtgggttatcagaggcaaacaccacccttaactgtctgtgacaagagtcatttgctatctcagcctattcctgagagtacattattttgagagagaactttaaaattattccttctatgccttaaaatgacatcccaaactttacataagagacttttaaatagagttgctattaaaacaaactacaccattaaaaattctagttgtcaatggccaaaagagaaatcctttaaatttgactaaaattcttaattaaaaaaaatttagagatctctcattctaaacaattaacttgtatttatgacaaggtcagttttttaaaaagatacataatagtatcatgactagccttaaaaattctcttaactaaattaaaaatcaaaaacaaaaagctaacctaaaacaaagttaaaaatcctttatgaaaaatcccccgagggaataacaacagaagccatgctgccttgtgctctaatagacaaaattccacacttttactgccattgcctgggtttcactcctgctcaaaaaatccgattcatttaatatttgtgtgacttttaacgttttgggggtacccatttgttataagtcattttcccttgtacagatagcttttgatttcctgtcttcctctttttttttttttttttttttttttttttgagaaggagtctcgctctttcgcccaggccggagtgcagtggcgctatctcggctcattgcaagctccgcctcccgggttcatgccattctcctgcctccgcctcccaagtagttgggactacaggcgcccgccaacgcgcccggctaatttttattttattttatttttgtatttttagtggatggggtttcaccgtgttagccaggatagtatcgatctcctgacctcgtgatccgcccgcctcggcctcccaaagtgctgggattacaggcgtgagccaccgtgcccgtccctgtcttcctctttttgagacgacatctggatttttgggcctttatgtatacacggtcagctataaaaccgagaccctaaaaaatatggccaaacaaaaatgtggattatatatacttcatttgttattaagaaaacttttctttttttcttttttttttttcggagacggagtctcgttctatcacccaggctggagtgcagtggcatgatctcggctcactgcaacctccgcctcctgggttcaagcgattcttctgcctcagcctcccagtaactgggattacaggggcccaccaccatgcccagctaatttttttgaatttttagtagagatgggatttcaccatgttggccaggatggtcttgaacccctgacctcaaatgattcacccgcctcggcctcccaaagtgctgggattacaggcgtaatcccagccaccgcacctggccaacttttctttctttaagccgtctttgggatagttctagatcttatgaggactgctttgtaccttttatagacgcttcatgcatccttggttaagtcataaggttaaccgagtcttaactttaaaaggtacctttagtctaaacaacaaaaaaagcaatcttcatgtttgttgatgtatagactactcaaaaagttcactaaaacatctgatataaactacaaaccagaaaaattatcagattgccactatctgctctcacttcatctaaagatgcttccagcccaacatctaaaaatcttctcaactggctgccctctggactcaaaaactgagtttacagtttattctagccattaatctttatttttattttgtttccatggaaatgcctcttatctgattgtcaaataatatagaagccagactttggcgaaagtccatctataacatcaatgcctaaaatgagatacaagcataaatattaactattcaactgaaccagcctattatcaggacttagagacttactcaaatggcttaaaagacaatccaccaacccaacttctgattgagaaacttctcgaggaagtttcatactgggggatgttgagcttcagaaaacaatacccaaaaataaaggcctcagaatcagtctcagaagcaaaaatttttctctgacctttccctgccctcctatctctcaatcacattctctcccagggctagccatagaaactaaaatctctctttcccaaggcaagtcacagaaaccagaactcctccctaaagctagttataaaacctaaaaaatatttctctaagttcccctctacctttacatataaaaactggctataaaaaaatcatctgatctattgggtcccgccccacacccagaaggaaggaatggatgctcagagaggccaagaaaaatctagacagacaggccttgatgggtttccccaagcagtgtattagcattatatcatacccctttcctccaatcatatttctacatggctgtccgtattttgttgaacctaaacataaaaatagacaatttcccctgtatctttgggtcttcattctgaaggctcctgtgtatactcgttaaataaatttatatgccttttctcctattaaccaattgcctcatgtaactgatgttttagcaagccttaagagggccaagagttcctcttgactcctacaccaggaacatgagaacatgagagaaaaggaagaacacagtttttaaaaagatgcagggaatctgaaaacagtatcaataaacatgggtgacctcacaactctaccaagaaacagcactacttaacatgttagaagtattctgcctctcccttagagcaaataggtctttcattattgtttatcttaactgtgttgaggagtttttgtttgttttcagacaaggtctcattctgttgcccaggctggagtgcagtgacacgatctcagctcactgcggccttgacctccttacctcctgggctcaagcaatcctcccacctcagccttcagagtagctagcactacagacgtgcaccaccacatccggttaatttttgtattttttgtagagccagggttttgccatgttgcccaggctggcctcaaactcctgggctcaagtgatcctcctgcctcagcctcccaaagtgctgggattacaggcatgagccaccatgcacgatggaggagttttcttaaggttacaggaccttgagcacttctgaaatttaaaagctataaaaacaatgagaaatgacccatatttattttattctgtatcaccagcctaattcttcaccattttgggttatatagtcagttagcaacagcctattgactatgaatttggtatagagcattgtactatggaataagaatgtacaaaacaattaaaaaagatagaccctgccctcagagagctcataattgcattggaaacacagacatgcaatcagtaatatgatttgcaaatacatgtatgattttcaaatatatattaacatattcacaaatatgcatgtatgcatatatgtgtatgtattcacaaaatgctcactcgaataactaaatgaaaaagacaagattaagtgttagtaaggatttacagcaattacaattatcataaaatgttgatgggaatgtaaatttgtataatcactttgaaaaactgtcagtgtctactaaaactgaatgaacatacatataccctatagcccaggaattcttctaggtatgtactcaacagtaatgtacatatatgttcttcaaaagatatttacaagaatattaatagcagcattattcacaagagtcaaaaactggaaacaacgcaaatggccttctacaataaagtgaaaaagttattgtggtatattcatttaacgaaaaggtatacaattatggaagtgaaaaaactacaaatacacataataacatgaataatttctcaaacaaggctgagtttcagtagagttaagatggtattaggtgaatgttgacagaaagaaatgataaacaagagagtaaagaccatatgattccatttatgtcaagtataaaaccaggcaaaactaatctatgctattagatgtcaggtgagtgattaccttcaagggagtagtgactggaagggagcacaaggggagtttcttggatgccgggaatggtctgtttcttaatctgggtccgggttacatggatatgtccactttgtgaaaattaattgagctgcacacttataatatgtttcctcttccatatgcatgttataaaataaaatttacatgttataaaataaaatttacttcaataaaatttacatgaaaatacacatctttatatacccccaaatacaaatacattcaggataaatgaacagcccaccataaataccaaggaatcctgtaagtaggaataaaagtcctatgtgtagaaatatgtaggaatcagaatcaaatggggcataactaagaagatatctcagggtgaggttgcagtcaggttttgaagaaagagcttacaaattggagggaggagtggtgaggagtttaggacagttaaaaagctgttttcaaatgagataaataacacgtatagaagcactagtcatgatatggcttgagttgtgacttctttttataacttggagaagtataaactaccaaaataatatgggcttttgactttctgttcttcttattctggattcctatgttacagtgtagtattgtgtcagaccatgaccccctccccaagggctagtaccaagtcttactcatctttatattactaccatctgaaacgaaagctatgaaacctcagataaaaaatgcttatagcttttgttaactaataatgaataagtaactggcaaattaatcaaataggtatatggaaactgtctcgtactggttttttgtcttgtgtattgtttaagttaaaataatagagttgggatgtcagaaattttctgaagccgaccacagtccccagctgtggcttagtaaccaaggaaaaccaaggatttctccttctgatccagcagtcggcacaatgccaggtgagtcagtgaccggtagagcaggtggtgacacattctaatcatagcccagctctaggcaaacagcagctgctaagagttcctgctggcctgagtaagttttccaggcccagccagccaagagcagccctagttaaaacccgccagcagttttcccatctgtctccctcatgctacttgcgacacttcacacatctcaccccaaagtgcattgggactcttgctccccgtctctactaaaactacaaaaattagccgggcatggtggtgcacatctataatcccggctacttcggaggctgaggcacaaaaatctctcgaactcaggaggcagaggttgcagagagctgatatggtgccactgcactccagcctgggcaacacagcaagaccccttctcaagaaaaaaaaaaaaaaaaacaataggcagaagtggcttagcacacagtactatggccgtcttccccaaagcttggactacagcaaccaatgtgaggcttagctctgcaaggagacccaaatcacagccacttcatgctgatcatcagttctttgctacctccacagtaattctagggatcatgccagccctggaggtggggagtcctggggggagggaaaaagggtgcaggctacagtgggtcaggattctaagggaaaacactgagtgaggaagctgtgagggccttcttaatgactggcttcttgagctgaaactggaaatcagagccctctggttatggacattggatttttcatatcccagagaacggttgttatgttttttttctctctgagaagccaacacaaacatttcagggactcagaagagtacattgtgtcctccctaattctcagtgactcctgctaattttccttgagatgtaatgaaaagaaccctgggtacattatcaggctgggttcaaactctatttcagctgcgcttctccattctagctgtgccactccaggcaaattagttagttcctccgctgataaaatagtgtcatcacaaagctcaatgataaatactaacttggtctccaccatatgtcaggcactgctctagctgctcattctggatttaccgcaaccctgttgggtagaagctaatattactaccctttatactgaaggaaaccaaaatatttcactctaaaatatatttccttgacatacttcaatatggctaatcagaacggctggaaatacaagaatagctaaaaagctttcttttgtggggaagatatgtatctgtagagaaaatctgcatggatgcagccaggctgtctctgaagccctcccttgttcaaaagatgaactgagagtctgacacctttcagggcctgaaagaaacattcactagctctctgaggactgctaccagtgaggtttcttctacataacaaaactccctttgttagctaagcctcctcttctccccctcccataacctgtcttgccactgtaacctgatttccaccataacttattttggccgtgctctgagatcacaatctttctgtagcctcaagatgatatataagcctctgtaccccattagagggttggagtaatcattctgtgattttccctcaatgcacgtgaatacatttctctgccttttctcttattaatctgccttttgtcagcggatttttcagcaagccctcacggggccaagggggagttttctcctggctcctatgacacagatgaagaaatgaggcacagagagggcatgcaacattcccagggccacacagctatgagcaggtgtgaagtctgaactcaggcaaactggctccaggcctgaccttttaaccaccatctcccagaaggtcaaagtgcctgggaaacatggagatggaacttaacacttgatgtattttactttttgaaaggtaatgtggtgcaatgaaaagaacttgggttttagagtcagactgactaaatccgatttaattgctgtgtgatcttgggcaaattacatcatttctctgagtctcagtatcctaaaaatgaagttgcaatcataatccatacattggagggccgctgggagatgtgcacttacagcaccaaacctggcacttgatgggcactcaagtgaacattaactttaatcctcttcctaggcaggcatatgtagagcactgaaatactcttctgtgagtatcctaacatgttaagcctttcttccttctaataaagaaaacaaacaggacaaataaaagccatccgctcatagtgatagacaggagacagccaagagtccctggtgaaaccccaccttcaagcctaaaacagcctgaaggctgaaaaactggactgctggtcccggatgaagcctgccctttcccagctgattccttctgaataatgcccacctgctcactgggaagattggtggagtctcaggaagttcgtgccatctgcagggggaaggagcctggcctctcctgttcctgggtggtgacctgggattcaatctgtgaggaaggaaacctgctagcaggactctcactttgctgagcattatttttccttcttcctttttgcccaataaattccattttcctcacccttctatgtgtctgcgagcctaatgtttcctggtcatgtgacaagagcccggtgtgagctgaactaaggagaaagttctgcaacaatagtacctcagggtctctctgcaactttcctgggacttttttctgatggaaggaaaataagaaataggaaagatgtttaaggaagcacccatccctgtaatcaatgataccaaataagacagaatgggcagccggagtgatagtcatcttcttaatgtaatcaactagtattctgccaaattcctctttatttttttgtcaggtcagacgggtaatgtgccaacgtctaacaagatgcgagggtggtacatctcacacatgcatgtgaacacccaatcgtcatgctcgggaactataaagggatctccaaattcctctgtagttaactaaacctactacaaagttgatttaacctctgagaaactgaaatgctgccttatgatacagcatttttaaaatttttctctcaaatctcaaatgctttaagacaaatccacttctttctttcatcttagggtaataaaatcattattcaaaccctgcaaaagcatgaatctcatttccttgcccccatctctactgagatattttaccaattaatatttactgtacagagtgggcctgttttaacattgcactccagaaagccttttactaaactattttcttgagagcacggtatcttgccgtaaagacaataactcccaagatcttttttcataacctctattagaatgtaaatcacaatagcaaatatgcactgacacaagtaccctgtaggttaagttgcttacacctgactaggaattgccacaaaaccctgatcaaatttgtcaggtttgacgtaggattctaagacttatttataaagcaatattttcaatatctccccagaactcccaaagctatatctgagacaatgataaaaatccatgaaattaatttcatcctcaaaatcaaagcagctgcattaataattaacttaatacatttcaaagccatctcaattgtgcctacaaatctagcacagattgagatcaaacctggaacacaattccattttccaaactatgaattaatgctgatgaagggtgaaactgctgacccaaaaatacctattacgttaaccatcattcacatcagcagcagcagcatcctgtcctttgcacaagaagtagacacctattgactcactttttagaaggctctgtccttgaaatattttgtcagtaagaatgttgaacttgatccagacatctttactcaatttcaattctgatcaacattttcaaggactctagccagggttaaatgagcagtctatggccaaggactaacacaaagttaactgttttaccaggaaatcaaacactttaccttgatccaataagcatctacagagttatggtgaatcacactgatatggtttaaatctgtgtcctcaccccaatctcatgttgaaatgtaatccccaatgctgaagatggggcctggttggaggtgagtggatcatgggggcagtttctcatgatttaacaccatcccccttggtgctatcatagcaataatgaattctcacgagatctggttgtttaaaagtatgtggcaccttccccctctcttgctcctactctggccatgtaagatgtgcctgcttcccgtttgcctcctgccatgattataagtttcatgaggcctcctcagaagcagaagctgctatgcttcctgtacaacctgcagaatcatgagccaattaaacctcttttctttacaaataacccagtctcaggtatttctttatagcaatgcaagaatggactaatatagaaaattggtaccaaggagtggggcatcgatataaagatacctgaaaatgtgaaagcagctttggaactggataatggggagaaattggaagagtttggaggcacagaagaagataggaagatgagggaaaatttggaacttcctagaaacttattgaatagttgtggtcaaaatgctaataacgatatggacagagatggccaggctgatgaggtctcagacgaagatgaagaacttattgggaactggagtaaagatcacttttgttattctttagcaaagaacttggaggcattgtgccccagctctagggatctgtggaactttgaacttgagagtgatgatttagggtatctggcagaagaaatttttaagcagcaaagtgttcaggaagtagtctgtctgcttctaacagcctatgctcatatgcatgagcaaagaaatgacctgaaactggaacttatatttaaaagggaaggagagcataaaagtttggaaaatgtgcagcctggccatgtggtagaaaagaaaaacccattttcaggggaggaattcaagctggctgctgaaatttgcataactaaaaggaaggcaaagtgctgatagccaagacaatggggaaaaggccttgaaggcatttcagagatctttaaggcggccctcccatcacagacccagaagcctaagagggaagaatggtttcctggaacaggcccagggccccactgtgccaggcagcctccagacactgctccctacatcccagctgctccacctccacccatggctcaaaggggcccagctacagctcagggcactgctccagagggtgtaagccataagccttggaggcttccaagtagtgttaagcctgcaggtgcatagagcacaagagttgagggttggcagcctctgcctagatttcagaggatgtatggaaaagcctggatgttgaggcagaggcctgctgcaggggcacagccctcatgaagaacatctaccagggtagtgcagacgggaaatgggaggttggagaccccacacagagtccccactggggcattccctagcggggctgtgagaagagggccattgtcctccagacccaagaaaggtatatcaaccagcagcttgtaccctgcacctggaaaggctacaggcactcaacgtcagcctgtgtgagcagctgcagaggctgaagcctgaaaaaccacagaggtggagctgcccaagaccttgggagcccacccctcacaccagtgtgccctggatgcgagacatggagtcaaagaattttattttggagctttaagatttaatgactgccctgctgggttttagacttgcatggggactggagcccttttcttttggccaatttctcccttttggaatggaagtatttacccaatgcctataatcccgttgtatcttggaagtaactaacttgcttttgattttacagcctcataggtggaagggacttgccttgtctcagatgagattttggactttggacttttgagttaatgatgaaataaggtaagactttggggggactgctgggaaggcatgattgtattctgctcctaattcagtcatgtaagatgtgcctgtttcccctttaccttccgccatgattgtaagtttcctgaggcctccccagaagcagaagccactatgcctcccgtatagcctgcagaactgtgagcccgttaaacttcctttccttataaattacccagtctcaggtatttctttatagcaatgcaagaatggactaatatacacaggaaatcagtttcacaactactacagagctcctcaagtataacctaaggatgctgaagaaaactgaatgaaagatccactacttcattattatttcagagctgtgattggaagcatgtacttaaacaccagctattcataatcacaggataatagatggtccctgaatttattcagggatttaaatttatggcttcatagaataaaaattacgcacttcccttaggaagtaaaatatttgtccatcccaaggaaagagaagcatattttattcaaccttgatgagaccagatttcagtgcagctcagtatgttatggtgggtatattagttttttaggactaccatgacaaagtattacgaacttggtggcttgaaacaacagaaatgtattctcttacagttctaaagtccagaagcctaaagccaagggatcagtaggaccagccttcctatgaaggttccagagaagaattcttccttaccacttattagcttctagtgtatcttgcaatccttagaaaagcttgagatatagcaccatcactcaaacctctgccctcattgtatatggccttcttccttctgtgtctgtgtgtccactccccatatgaagacaccagtcattggatttagggcccacactaatctagtatgacctcatcttaactagttacaactgcaaagattctagtttcaaataaggtcacattctgaaactctgggtggatgtgatattctgtagggcactattcaacccactacagtgggcactctcaatcggatatggtgccaaagagtcacagctcttagcagattaatctcctataaggcttcttggttccacataagagcaggagactgcgaactgttttccctccaggtcttcacactttagtgtaatttggtagtctacaagcaatgcccaatttagagcagtatactaaacatgtgcagtttttaccttcttttatttgccaaggtatcttagctcttgacaaaagttaaaattgacatagaaagcagaaaaagcagtgatttaaactaaaactcttttaaaatgttgaccaaacattaattcacactagccaaagaggaaggtgattctaatgttcagccaaattgttaacaactttagagcagtggttttccaaatatgatctctagacaaacagcataggcatcatctgggagctcctaagaaatacagaatctcagccctcactccaaatccatagaatcagaatcttcattctaacgttattctccagatgactgatgtgctctgttctaaaactctgatgccaaaagtaaaagtctaaccctcccatgtaattctatactttctggcaggaatgggtatttgttttgctgagggctgatagggaatgttaaacacatacacacttgcacatactggtcctttgccttcccacagagtggcagcagctttccaaatgaacaagctgtttccatgacaccaaatccttaatttgaagcagatacaccaaccacccaggagcgtgatagcatgaagcaccatttcatatttattttatttaggttcttggtctcaaacatctcctccttgaaaaagaaatctttgagaagaaacactaatatttaaagcaacactttaattggcaaatttgtcccctttctttgtcctataaatagagcactctgaattattctgttaagtcccttttcatgattaatcaatcagagataatatgaatgactagtaaattaattatactactatgagtatacagtctgcccatctagtgaatgttttccttttctcgatcacagttccaggccattttattcttaatacattctttaaattcaacttattctttgctgtgaacatgtatctttctgtcactcctctgaacaaataatggaaaaattctccattttgcatcatctatactgaacaatatcctgacatgagagaggcaaactcaggaatgtgactaaaagcaatttatttgcattaacagcagcatggaaagacggtgaatcgagtctagcatgtcctgaacaagcctcctttaaatgtttatctccacagcttttctaaattaatttaccccaccaacaaatttaaagggaaacaacagtgtgttgaatgccaaccagttaaaaatagtcaagtctgttctgcagggaacagatcaaattcaaaagtacagaaaggagccgtgtgcaaagagggcaattaaataagcacatacataatatggctcacagtcacaaaactgcaggctcaggtgcaaatcagcttcactgtcagaaggttcaggcaggagctgttagaattcttcacagcattttcgagcccgggacacctaccaggctttcacccacctgctcacacaccagataaaatttgagaaaaagagagtgttgcttgaatgcataattcccaaatgcctaaggcaaatagaggtctgaatctgagggattcacccattctttgttcctatgctcctgagattcagccattcagtcccaggattgtagggtatgaatcattgctgtaaatcattttggatttctaaatatataaggacaatttaagagaaaaaacaaggtgacattccttccacaaccttcaagagctggctctgtgacaagaatcagcaccaggggaacccagccacgagaaagaagaggtagcccagaaaaatcccttctagacggaaggataacaggaaatgggataaaggagcagggaatgaagcaaggactgacaaaacagagctgagcttagagctcaaccagctgccttctctatcatgtaaatttctcaaggagttacatgggctgcatttgctacacaggtgttgcagctgccctctcatcccatatctccatgaggatgtggcccatgtctattttcttcatagttgtatctccagcattgagtacactgataggcattagtaggagcacaatgtacatatttgatggaattaactgattaatgaatgaaacaaaaaggttcccagcaaagtttatcaaatactatttttgtagaattatcattataattatcattataaaaatgatacctgtatttttctggggaaatgtggaaaagaacatttttccatagacaaaataaaatcacatactgaaatggaagaaaaactgtaaatctcattaaaggaaacaattgtgctctcctaataaaatattatacataatataaatggaaacataagcatgaaataagtaaggattttctttttttagtttggctcaataatttatccagcattgatagcctagctgaacagaaaagctaggccagcgaagctactgaactttgatcaaagttcctgcacaatatttttgcctctgtatttcacagtaacattcaacttcccttggatcctcagattcaaacatactatggaagttgatggtggtgatgactaaatttccctggatggatgaacaaaacaggtttatgaaccaatttgcagcagcaattaacaagcatatgaagaagatactgactagaatatatgaaagaggctgggaaagtatttttagcacaccaacatgcagtagaaatgtaggagggagtgaatcttggcagtgtaaaaggtctaattgtgttgcagatgctctactatgtgagaaatcttaatagctcttacaccatcccaaatccctgacccagccccaggctcattcggcatccagtaacggaatagatggagctacactcacagcccccacagcaagcagatggagaagcagcagcaggattctgtatgggggaggttgatgcccagtgctccctctagcactaaaattctgtgggaacctggattgcccaggacacaaaagtagaccataataaagtgttgtgactttccaatccctctgtcacaccttcccaaagtcagatgtttctaaagggtactccacatgggctctgcacttctctgttaccctcctgatgcagtctctgtgagagctcaaccatggatgtcatcagagctcaggtcttaggccctgctgctcaccacatatcagacaaagaggttacctcccgtctcggtctgcacagggatgactgttcataactgctgtccaggtcacaccacatgtagcatataccagcctgaccctatcacctctggctcgcaccattcctggacatgcctactgcctcccactgccagcacctgcagctttccacctgagggctttctcatatgagggcagacaggaagtgccgggagttagttaccccaggagtagttctcagccagaaatgatagaattggaggataaaatccctagcttccttgccctttggatggaataactctgaaggatgttttatattatctctcagatgcccctagtaagactgagcttcacccacagtggtcatctgctcaatggtgtacactttattgccatttgttacaaaatatacttttgtgttttataacccagccctcatttccaagcaaggaaacaatggaattgcttttgttcccacacagacaagtactttaacattacaatttcctatgaaagaggaagtgtggcaggcatgtcagagactgcccatttaacctcaggccttaccattgtaagctggcggactgccagctgccagcacctacagctctccacctgagggtttgctctggctaccagggcccactttgccacccacaacatgctagaaacagcagggagttgatacactcaggagcagccctcaacctatgactgagagggatagctctgaaacacttattccatgctggctctcagtattcctagtggaatcatgctccagttacccgtgatgctaacttgcttgataacactcccttcccttccccttctccttctccttccccttccccttccgctttcccctcgtgtctcctcctgtcccctccctgtgtcctcccttcccttcctcttttcccaccccttcctcccctcccttccccaattcacttccccactctcctgtcagtgtttcctgggatcaatttccaaattaattacagttgccccttgctatccatgagggattggtttcgggacttccccacagataccaaaatccacagatgctcaagtcccttatataaaatagtgttgtttttccatataacctatgcacatattcttgtatactttaaattatctctatattacgtataatacccaatacaacgcaaatgctatgtaagtagttatactgtcttgtttggggaataaagacaagggaaaaaatctgtaaatattcagtagagacacaattatcccatttttctgaatatttttgatccacagttggtcaaatctactgatgtgtgtgtaacccatggatatagagggctgactgcacttgtactcgtgtcttagcctcagggtctgtttctagggaaagatagtaagatagggaagagatgcaattccaaatgtctgtgactctaaatgccaaataagcatccagagaaagacacgaacccttaaatccctaaattttgtttcctacaaagattagtgtgaaggtaaaatgaagcccttggagttccaaggcctcaggattatttaccaaaaagtttatctctaagaacacttctgagcccagtactgagttaccaaagattctaatgtactactctggtccttcagcatttcttttgtatctattccacaggatataatgagcctcttaaaagaacctgcctggtcaaaattttaaaaaatatttgtttttatttttgtgggtatgtagttgctatatatatatatatttatgggtttcatgagacgttttgatacaggaatataatataaaatacgcaaattatcaagaattgagtatccattccctaaagcatttttgctttgaggtacaaacaatccaattacactctttaagtaacttaaaatgtacaattcagttattattgactatagtcacctggttgtgctatcaaatagtaggttttactcattcttgctactttctgtacctgttaaccatccccatttcctcccagccccccactacctttctcaggctctaataaccatccttctactctctatttccatgagtttaattgctttgatttttagatctcacaaaaaagtgagaatatgtgatgtttgtccttctatgcctggcttatttcacttaacataatgatctccagttccatgcatgttgttgcaaacgattgaatttcatttttaatagctgaatagtactccatcatgtatatgtaccacaaattgtttatccattcatctgttggtagatgctcaggttgcttccaaatcttgcctattgtgaacagagctgcaacaaacatagaaatgtagatacctcttcaatataccgatttccattcttttgggtgtatacccagcagtgggatacctgggtcatatggtagctccatttttagttttttgaggaatctccaaactgttctccaaagagggtgtacttatttacattcccaccaagagcgtacaagggttcccttttctccacatcctcgccagcatttcttattgcccgtcttttaaataaaagttattttaactgaggtgagatgatatctccttgtagttttgatttgcttttctctgatgatcaatgatgttcaacaccttttcatatgcctgtttgccatttgtatgtcttcttttgagaaatgtctattcaaatcttttacccatgttttgattggattgttagattttttttctacagagttgtttgagctgcttatatattctggctattaatcccttgtcacatgggtagtttgcaaatattttgtcccattctgtgagttgtctgttcactttgtggattgtatcctttgccatgcagcttttgaacttgatgcgatctcatttgtccattttagctttggttgacttagcttttgtgacttgtgcggtattactcaagaaatttttgcccagaccaatgtcctggagattttccccaatgttttcttgttggagcttcatagtttgaggtcttgatttaagtctttaatccatttttatttgatttttatatatggtgggagagagaggggtctagtttcattcttttgcatatgcatatccagttctcccagcaccatttattgaagagactgtcttttcctcagtgtatgctctcggcacctttgttgaaaatgagttcattgtaggtgcatggatttgtttctgtgttctctgttctgttccattggtccatgtgtctgtttctattcaatgtgtctgtttttatatcagcactatgctgttttggttactgtaactctgtagcataatttgaagtcaggtaatgtgattcctccagttttgttctttttgcatagaatagctttggctattctgggtcttttgtgattccatataaattttaggattgtttctatttctgtgaagaatgtcatggttattttgatatggattgcactgaatctgtagattgctttagatattatggacattttaacaatattgattcttacaacccatgaatatgaaatattttcccatttttggtgtcctcttcaattactttcatcaatgctttctagttttcattatagagatcttttacttttttggttaagttaatttctagctatttaattttatgggtggctattgtaaatgagattactttttaatttctttttcacattgatcatgttggcgtacagaaatgctactgaatttgcatgttgattttgtatcctgcaacattactgaaattgtttatcagtattaatagttttcttgtgtagtcttaaggtttttccaaatatgaaatcatatcatctacaaaaaaggataatttgacttctttccaatttggatgccttttatatgtttctctcatctgctctagctagtacttctagtactattttgaataagagtggtgacagtgcacatcgttgaggtattccagatcttagagaaaaggctttcaggttttcgccattcaggatgatacaagctgtgggtctgtcatatattgtttttattatgttgatgcatgtttcttccatccccggtattttgagggtttttatcatgaagggatgtcgaattttatcaagtcctttttcagcatcaatgaaaatgagactcttgttctcttcccttactttctctaaaacaaatggaggttgtgtctctgttctgagccacttacagctgggggtgaagtaagtaagaccagcatccctgtggtcaccaccgctatgactgcactgggtctgacctaaagccagcacagcactgggtctcacccaaagcctgctgtaaccactccctggttgctgcctatgttcgctctccctccccgagcacccaagagagactctccacaacacgccgctgctgccacaaggaagcggggtgggcattgtgattcaggacaattttttctatctcctcactgtctctttcagtgatatgaaattataaccaggtactatgaacgctctgattttttggtttttctgaagatgtatttttctgtgtagataattgttaaattggtgcccttgttggggcgatgatcagtgaagcattctattccaccatcttgctccacctcccatctgcctagtcaatcttataaaagttttaagtcgtgctgagtgcggtggctcacgcctctactcccagtactttgggaggctgaggcaggcagatcacctgaggtcaggaattcaagacccgactgaccagcatggaaatatcctgtctctactgaaaatacaaaattagccgggtgtggaggcccatgcctacaatcccagctactaaggaggctgaggcaggagaatggcttgaacccggaaggcggagtttgcagtgagccaagatcgcgccactgcactccagcctgggcaacgagagcgaaactccgtctcaaaataaataaatgaataaataaataaataaaatgaaaagttttaagtagtgagtaacatatacttagaaaatattaaaacactgtacccatgtgttcttcacctttcaaagtgcactttaacaaagttgtcatcttttattcttattataaaagtaatagaggctcattgtagataatctgaaataatgtgcaaaattaagatcatgctatgtaataatattttaaaataaataaaatacttattttaaataaatacagctctcaatttgccataatcatttgggctgaggaatcatgaataatattgaaacaacaaataatataacaaaaaaacccatccgtcattttgttttttctttaaatctcgtccttctcctccactttgatgaatccattttacatgaactgttttcttaaccgaagtagactgattaaaatgtaacaaccttttccctctctgcccacctttctaagaactgttaatgaacagtaaactggtcaatcagcagggtcaaagagcagagaaaagtaacagaggcaaagttgatggagatgacaactagcttgtttttttttttattgtcatactttaagttttagggcacatgtgcacaatgtgcaggttagttacatacgtatacatgtgccatgttagtgtgctgcacccatcaactcgtcatttaacattaggtatatctcctaatgctatccctcccccctccccccactacacaacaggcctcagtgtgtgatgttccccttcctgtgtccatgtgttctcattgttcaattcccacctatgagtgagaacatgcggtgtttggttttttgtcctcgcgatagttggctgagaatgatggtttccagcttcatccatgtccctacaaaggacatgaaatcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttacagcagcatgatttataatcctttagatacatacccagtaatgggatggctgggtcaaatggtatttctagttcaagatccctgaggaatcaccacactgacttccacaatggttgaactagtttacagtcccaccaacagtgtaaaagtgttcctatttctccacatcctctccagcacctgttgtttcctgacgtttgaatgatcgccattctaactggtgtgagatggtatctctttgtggttttgatttgcatttctctgatggccagtgatgatgagcattttttcatgtgtcttttggctgcataaatgtcttcttttgagacgtgtctgttcatatccttcgcccactttttgatggggctgtttgtttttttcttgtagattcttttcttgtagatttgtttgagttcatttgtttgagttcattttttgagttcacagccctttgtcagatgagtagattgcaaacattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcccgaatggtattgcctaggttttcttctagggtttttatggtttcaggtctaacatttaagtctttaatccatcttgaattaatttttgtataaggtgtaaggaagggatccagtttcagctttctacgcatggctagccagttttcccagcaccatttattaaatagggaatcctttccccattgcttgtttttgtcagatttgtcaaagatcagatggttgtagatatgtggcattatttctgagggctctgttctgttccattggtctatatctctcttttggtaccagcaccatgctgttttggttactgtagccttgtagtatagtttgaagtcaggtagcgtgatgcctccagctttgttctttggcttaggactgacttggcgatgcggctcttttctggtttcatatgaactttaaagtagttttttccaattctgtgaagaaagtcattggtagcttgatggggatggcattgaatctataaattaccttcagcagtatggccattttcacgatattgattcttcctgcccatgagcatggaatgttcttccatttgtttgtatcctcttttatttcattgagcagtggtttgtagttctccttgaagagatccttcacgtcccttgtaagttggattcctaggtattttattctctttgaagcaattgtgaatgggagtttactcatgatttggctttctgtttgtctgttattggtgtataagaatgcttgtgatttttgcacattgattttgtatcctgagactttgccacgcaaaccaataaatgtaattcagcatataaacagaaccaacgacaaaaaccatatgattatctcaacagatgcagaaaaggcctttgacaaaattcaacaactcttcatgctaaaaactctcaataaattaggtattggtgggatatatctcaaaataataagggctatctatgacaaacccacagccaatatcatactgaatgggcaaaaactggaaacattccctttgaaaactcacacaagacagggatgccctctctcaccactcctattcaacacagtgttgtaagttctggccagggcaatcaggcaggagaaggaaataaagggtattcaattaggaaaagaggaagtcaaattgtccctgtttgcagatgacatgattgtatatctagaaaacgccatcgtctcagcccaaaatctccataagctgatagataactagcttctttagataatcaaggctgattgtgcattcactttcccatgaatgtctaaagctgtgaagggcaattgccgagtgcattaagagaaaggagctctatctgggagttctttgtagtcaatacaaggaggaaagaaggcccccagcagatgtgctcctgaatttgttgaaagattggaagatatcccctctgaaataacagttaacaagaactagcaaataaaataaaagagcttgcatataaacagtagatgcctccccagtagacaactcatctaaaagaactcttaaagacactggttactgataaaagagaatgatttttgaaaccctgaggcagagcaagatggcaaaatagaggccgccccgcctgggaagtgaggggcgcctctgcccggccgcccttcgtatgggaggtggggagcacctctgcccggccgccctgtctgggaattgggcgcctctgcccggccgccccgtctgggaggtgaggggtgcctctgcccggccgccccgtctcggaggtgaggggtgcctctgcccggctgccccgcctgggaggtgaggagcgcctctgcccggccacccttcgtctgggaggtggggagcgcctctgcccggctgccccatctgggaagtgggcgcctctgccgggccaccccatctgggagttgaggggcgtctctgcccggctgccccgtcagggaggtgaggagcgcctctgcccggctgccccgtctgggaggtgaggagcgcctctgcccggctgtcccatctgggatgtggggagagcctctgcccggccgctctttgtctgggaggtggggagcacctctgcccggccaccccgtctgggaggtgaggagcacctctgcccggccacccatcatctgggatgggaggagcacctctgcccagctgccacccgtctgggaggtgaggagcgcctctgtccggccgccaccccatctgggaagtgaggtgcacctctgcccggccgccccgtctgggaagtgaggagcgcctctgcccagccgaccattgtctgggatatgaggagcacctctgcctggccaccccgtgtgggaagtaaggagcgcctctgccagcccgccctgtctgggaagtgtacccaacagctccgaagagacagcgaccatcgagaaggggccatgatgacgatggcggttttgtcaaaaagaaaagggggaaatgtggggaaaagaaagagagatcagattgttactgtgtctgtgtagaaagaagtagacataggagactccattttgttctgtactaagaaaaattcttctgccttgggatgctgttaatctataaccttacccccaaccccgtgctctctgaaacatgtgctgtgtccactcagggctaaatggattaagggtggtacaagatgtgctttgttaaacagatgcttgaagacagcatgctcgttaagagtcatcaccactctctaatctcaaatacccagggacacaaacagggccaaaggccgcagggacctctgcctaggaaaaccagagacctttgttctcgtgtttatctgctgaccttctctccactattatcctatgacgctgccacatccccctctctgagaaacacccaagaatgatcaatactaaaaaaaaaaaaaaaaaaaaagatggcagaatagaagtctccaccaatcatcctccccaaaccccactgcaaggacataaagttaacaactatccacacaaaaaagcacattcataagaaccaaaaatcagatgaccactcaccttatctggttttaacttcatatcactgaaagagacactgaagagacagaaaaaacagtcttgaatcggcaacagcactcctcctccatccccacaacagcaatggcagggtgtggagagcatctctgggcactgggggatgggagaacccagtaattgtgaggcactgaactcagtgctctcctgttatagcagaaaggaaaactggaccaaactctgctgatgctcacccacagaggagggtttaaaccagtcctagccagaggggaatcgccgatcccagtcgtccaaacttgagtttagcaaacctcgccaccacaggctaaagtcctctggggttctaaataaactcaaaaggcaatctaggccacaaggactgtaacccctaggtgagtcctagtgctaagctgggcaaagtgacagtggactggggcatgtgacctactgagacaccaacaaaggtggctaaaggaatgttgacatcacccctcccctaacccgaggctacacagctcacaactccaaaacagacccatttcttctgcctaaatagaggagagagaagagtggggagtattttgtcttgcatattggataccagctcagacacagcagaataggacactagtcagagttctgaggtaccctctccaggccctagctcctggacaacaatacacaccatgggccacaagggaatctgctaccttgaaggaaagaacccggtcctcgcatcattcatcacatactaactgaagaggccttgggccctgaataagcagcagtgatacccaggtactatgttgaaggctctggatgagagtctgagacttgctagcttcaggtgagactcagcacattcccagctgtggtggctatagggcaagaatcattgtgcttacaaaaagcaaagggaaaagtaaagtggacgtaaagtggactttctattgcacctaaggtaccagctcagccacaggagagtggagcatcaagtgggctcttggggatcccaattctaggacttggctcctacacagcatttctggacctgccctgggccagaagggagcccactgccctgaagggtgggtcccaggccaggcagcattcaccacaagctggtttaagagcccttgggccttaaaggaacataggcaatagcctggcagaactccccatgggcctgtggtggtgatgaccatagggagaggctgctctgctttcagagaggaaagggacgagtagaaaggactatgtccactggtttgggtgccggatcagtcacagtacaatagaataccaggtaaacgtctaatatttttgaacctagtccctggctcccagacagcccctctggaactccctgtggcctggggaaactcagtaacctaaaagaaaggatacagacctggctgcctttgccttatgctgactgtagagcctcagggccttgagcaaacataggcagtagccaagaagtggttacagcaggctttgggtgagactgagtgtgctggcttcaggtcagacccagcagtcatagtggaggtggccacaggggtgcttgtgtcactccataaccagcttaggtgactcagaacagagagaccttctttgttttagacaaagtaagggaaaagaacaagagtctctacctaataatccagagaattctcccagatcttatccaagaccatcaaggtagtacctttgcaagtctgtaagaaccacagcaacacagggctggggtatcccctaaagcagatatagcttatattacaacacccaaatccttacaaatatctagaaagctttcccaagaaggaagggtacaaacaagcccaaatgcaaagactaaaatgaatacataactcttcaacggccagacacagatgaacaactagaagcatcaggatgatccaaggaaacattacctcactaaatgaactaaataggtcatcagggaccaatcctggagaaactgaagtatctgacctctcagacacagaattcaaaatagctgtgttaagcaaactcaaagaaattcaagataacacagagaaggaattcagaattctatcagataaatttaacaaagagattgaaataatttaaaagaatcaagtagaaattatgaagctgaaaaatgcaactggcatactaatgcatcacagttctttaataacagaatggatcaagcagaaggaagaattagtgagcttcaagacaggctgtttgaaaatacacaatcagaggaaacagataaaaaataaaaaacaatgaagcacacctaaaggatctagcaaatactttcaaaatgacaaatctaagtattgttggccttaaagaaagggtagagaaagagacagtggaagacagtttattcaaagggataataacagagaacttcccaaacctacagaaatatatcaacgtccaagtacaagaaggttatagaacaccatgcagatttaacccaaagaagactacctcaacacatgtaataataaaactcccaaaggtcaaggataaatagaggatcctaaaagcagcaagagacataaaacaaataacacaaaatggagctccaatatgcctggcagcagactttcagtggaaaccttacaggccaagagagaatggcatcacatatctaaagtgctgaagaaaaaatacttttatcctagaatcatatatccggtgaaaatatccttcaaatatgaaggggaagtaaagattttcccaaacaaaagctgaaggatttcatcaacaccagatctgtcctacaagaaatgctaaagggaatacttcaatcagaaaagaaaggacattaatgatcaataaataatcacgagaaggtacaaaacttactggtaatagtaagtacacagaaaaatacataatattataacactgtaatggtgatatataaactacccttatactaagtagaaagatcaaaggatgaacaaatcaagaatcataactacaacaacttttcacaacatagtcagtacaataagatataaatagaaacataaaaagtgaaaaaagttaggggagaaagtaaaggtgtacagcttttaatagttttctttttgcttgtttgtttatgcaaatagtgttacattgttatcaggtaaaaataatgggttatacgatagtatttgcaagcttcatggtaacctcaaaacaaaaaacatgcaatggatgcacaaaaaataaaaagcaagaaactaaaatatatcaccagagaaaataatcttcccaaaaagaaaacaggaggaaaagaaagaaggaagggaagaccacaaaacattcagaaaacaaattataaaatggcatatggaagtccttacttatcaataataacattgaatgtaaacggactaaactctccaatcaaaagacacaggctgactgaatggattaaaaaggcaagatccactgatctgtttcctacaagaaacactatctataaaaacacacataaactgaaaataaagggatggaaaaagatattccatgccaatggaaaccaaaaaaagagcagcagtcactatacttagaccacacaaaatagatttcaagaccaaaactataagaagacacaaagaaggccactacataataataaagaagtcaattcagcaaaagtatataacaagtttaaatatatatgcacccaatattggtgtacacagatatatgaagcaaatattattagagctaaaaagagggatagactccaatacaataatagctggagacttcaacacctcatttcagcactggacagatttttccagacagaaaaacatcagagaaacatcacatttaatctgcactatagaacaaatggatctaatagacatttatagaatattttatccaacaacatcagaatgcatattcttttcctcagcacatggatctttctcaaagatagaccacctgataggtcaccaaaaaagtcttaaaacattccaaaagactgaaataatatcaagcatcttttctgaccacaatggaataaaactagaaattaataacaagtggaattttggaactataaaaataacggaaattaaacaatatgcttctgcatgaccagtgggtcagtgaagagattaagaaaaaaaaacctaaaatttcttgaaacaaatgataaatgaaaacacagcataccaagatctatgggatacagcaaaagcagtactaagagggaagtttatagctactagtgccaacattaaaaaagaagaaaatcttccggtaaataatgtagctatgcatctaaaagaacaagaaaagcaagaacaaacgaaacccaaaatggtagaagaaatgataaatgtcacagcagaaataagtgtaattgaaatgaaaaaaatacaaaacatcaatgaaacgaaaagttggtttttcaaaaagttaaacaaaaatgacaaactctagcctgactgaaaaaattagaaaataccaaaataaatgaaatcagagattaaaatgaagacagcacaactgatactgcagaaattcaaattagcattaccaactactatgagcaactatatgccaataaatagggaaattagagaaattgacaaattcctagatacatacaacctaccaagattgaaccaggaagacatgcaaaacctgaacagaccaataagaattaatgagatcaaagccatagtaaaaagtctctcagtaaagaaaagtccaggacactctggcttcactgctgaattccactaaacatttaaagaagaactaataccaatcatactcaaactattctcaaagagagaagggaggagtacttctaaattcattctataaggccagtattaccctggtaccaaaaccagacaaagacacatcaaaagagaaaactgcatgccaatatctctgatgaatattgatgtaaaaatcctcaacaaaatactcccaaaacaatttcaacaatacattacaaagatcattcattgtgaccaagttggatttatccctgggaaccaaggatggttcaacatatgcaagtcaatcaatgtgatgcatcatattaagagaatgaaggatgaaaaccatatgatcatttcaattgatgctgaaaaaggatttgatgaaattctacatcctttcacgataaaaacccctcaaaaactggtaatagaagagaaacatacatcaacataataaaagccatatatgacctactcacagctagtatactgaatggagaaaaactgaaagctttttctctgagatctgcaacatgaaaaggatgctcacttataccactgttgttcaacatagacaacagaaggaaatagggcacccaaattgaaaacaaagaggtcaaattatctttgtttgcaaatatgatcttatatttgaaaaaaactaaaaatgccattaaaaactattggaacccataaacaaactcagtaaagctgcagaatacaaactcaatacaaaaatcagtagcatctctatatgctaacagtaaacaatctgaaaaaatatcagaaaagtaaccccatttacaataaccacagaaaattaaatatctaggaattaactaaaccaaagaagtgaaagatgtctataataaaaactataaaacactgatgaaagtaattgaaaagacaccaaaaaatagaaaaatattccatgttcatgaattggaagaatcaatattgttaaaaatgttcatactacccaaagcgatgtacagatttaatgcaatttctataaaaataccaatgacattcttcacagaaatagaaaaagataatcctaaaatttatatggatcaacaaaagaccaaaaatagccaaagttattctaagcaaaaataaatctggaggaatcccaatacctgagttcaaattatactacagagctatagtaaccaaaacagcatgataatggcataaaaacagacatatagacaatatgaacagaatagagaacacagaaataaatccacacacctacagcgaacttattttcaacaaaggtgccaagaacatatactgcagaaaagacagtctcttcaataaatggtgctgggagaactggatatgcacatgcagaagaatgaaactaaactcctctctctctcacaatatacaaaaatcaaataaaaatggattaaaggcttaaatcaagacctcaaactatgaagctccaacaagaaaacattggggaaaatctccaggacattggtctgggcaaaaatttcttgagtaataccgcacaagtcacaaaagctaagtcaaccaaagctaaaatggacaaatgagatcgcatcaagttcaaaagctgcatggcaaaggatacaatccacaaagtgaacagacaactcacagaatgggacaaaatatttgcaaactacccatgtgacaagggattaacagccagaatacataagcagctcaaacaactctgtagaaaaaaaatctaacaatccaatcaaaacatgggtaaaagatttgaatagacatttctcaaaagaagacatacaaatggcaaacaggcatatgaaaaggtgttgaacatcattgatcatcagagaaaagcaaatcaaaactacaaggagatatcatctcacctcagttaaaataacttttatttaaaagacgggcaataagaaatgctggcgaggatgtggagaaaagggaacccttgtacgctcttggtgggaatgtaaataagtacaccctctttggagaacagtttggagattcctcaaaaaactaaaaatggagctaccatgtgacccaggtatcccactgctgggtatacacccaaaagaatggaaatcagtatattgaagaggtatctacgtttctatgtttgttgcagctctgttcacaataggcaagatttggaagcaacctgagcaactaccaacagatgaatggataaagaatttgtggtacatatacacaatggtacatatacactattcagccatgaaaaaatgagatcctgtcatttgcaacaacatggatgttactggagattattatatcaagtgaaataagccaggcacagaaaataaacattgcatgttctcacttatttgtgggatccaaaaatcaaaacaattgaactcatggagatagagggtagaaggatggttaacagaggctgggaggggtaggggaagagtacagtggaagtggggatggtgaatgggtaccaagaaaatagaaagcatgaaaaaaaaactagtatttgatagcacaaccaggtgactatagtcaataataatttaattttccatttaaaaataagagtataattggattgtttgtaacactaaggataaatgcttgaggggatggataccccattctccatgatgtgattattacacattgcatgcctgtatcaaaacatctcatatgctccataaatatatagacctactatgtacccacaaaaattaaaaataattttttaaagaatgattttctaaaccccataacgggacctgggttatgttctgaaatgaaatctaaaatataactactgtgagataaactatagtcttggaaaccaacttctctaaaatgaggaataaagacagaaaatttgtgaaaactgaaaagggaggaaggaggaaggctgtgacaaaaactaacattggttgattactatgtatacattggcctaggtgctttatatcagtcgcatctcaaattactcgatgaaatgcattttactctttccacttgatagatgcggaaaccgaggctcagaaagattaggtaataggccaggcacagtggctcacgtctgtaatcccaacactttgggaggccgaggtgggtggatcacctgaggtcaggagttcaagaccagcctggccaacatggtgaaacctcatctctactaaaaatacaaaaaattagccggtggtggtgcatgcctgtaatcccagctacgttggagggtgaggcaggagaatcgcttgaactcaggaggtggaggttgcagtgagccgagattgtaccactgtatgccagcccgggcaacagagcgagactccatctcaaaaaaaaaaaaaaaaaaaaaaaaaagaaattaggtaataaacaactagtaggtggaagagctggcattccaatccatgattgccttaatccagagtgtgatgcagtaatatgttaacgtttaccagaaatatttctggcaagataatgccctaattatgttaaactgttatggttacaaacaccaaaatacttttgcaaccagctacaaaacctaataggggtataccttaagtccatttaattcctatttcttaccaagcaaacatgtaatgtttgttgcctccagaatgggcgtcccctgtataaattactgtgggtagttatccttccaatgagagttctcaatgtacattgataaactggcaatttgtggctttgattagtaaagaagtcattgaatttgctacccagcaagtatttactccatcctgtctaccctgcctttatcctttctaatgaaacctctaaaagcctcgtccacatgcccatgtgcttcactaaattaaacaggcatcccattcctctagccagggagtgtttcaggaatgggaatgtcacataattctgaaatagaaggggaagtacactagggaatttctgggaattttttttttcttttttttcttttttgagacagagtctcactctgtcgcccaggctggagtgcagtggcacaatcttggctcactgcaacctccgcctcccatgttcaagcgattctcctgcctcagcctcctgagtagctgggattacaggtgcccaccaccacgcccggctaattgttgtatttttagtagagacagggtttcactatgttgcctaggctggtctcaaactcctgacctcaagtgatccacccacctcggcctcccaaactgctgggattacaggcgtgagccaccgcgcccagccttgggaatatttctttatcccgaatgaaaagcacactaactagggttccttgaatgaacatctaatttcagagaatgtacaaggtaaacagagaatagacatcttgttttgtcagaaagcaaagggccttccaaagatgaatggagtcacataagaatgacataatagccatcaggaagggtctccccttgaccaaaattgggagaacttgagtatcaaaagaataagaactataattggctgaaaagctttgaatatttttttaaaacatgagttcaaactaatatttttaaaagaaagtaaaaacaaagaatcaaacttaattgtcaccattacaccaacaccttactctgaaaattggtaaaatttaagaggtaacaatttatcttgcctttctagtagaaatggtacttgagagtaacctaataaatagccctagttgattgctcctcgaacagtgagaacacatggacacaggaaggggaacatcacactctggggactgccgtggggttgggggaggggggagggatagcattaggagatatacctaatgctaaatgatgagttaatggatgcagcacaccagcatggcacatgtatacatatgtaactaacctgcacattgtgcacaggtactctaaaacgtaaagtataataataataataataataataaaaagaatttcagctaataaatatggttttgtaaattctaatgaaataattgattcaggcaactatcttcagtggaagctaaagccattaagtgtctcttctgggtcttcgttgtcagaaaataaataaagccattacatgaaaagagaaactggatagtttcatccagagccaaggtatcaactccaaaattatttagtagttgcaagagaaaaaatgttataaaatgttattttgtaataaaaagattgagctgaaatccccttattttaacatcactatgtgattgattttaacatcactaaaaatgagaaatcagacattatatgactcagtgtaatgcaataaatatacagcctcatctctgaagtatttcttccaaaaaatatttaatctgaatctatacaactctttagatctaatatccagtttacaggaaatatggaggacagagaaatgcatcaagaaaattcagacaaagcctgaatttgagtcattctataggacaacaggactgggcccttcaatacttcaattttatgaggaaaaaaaaaagaagacaatgttctagagtcaagacattctagaagagatttaggagataaaaagagatctaaaggcgacatagtagatataacaacaatatgcactgcataatccttgattagattttatgtgtcaaaaaaaaccccaaaaagttaaaaggcaagctagcataaaaatattgacaaagtattaatgtcatttatttatatagctctcttaaaatcaatttaaaaaaaacacttcaggtgaaaattggcaaaggatataatagatcatagaaacacaaattaaaataattaatgtaaaaaagacacttttatgctgggcacagtggctcaggagtctgaggcaggggaatcacttgaacatggaaggtggaggatgcagtgagccaagatcatgccactgcactccagcctggatgacagagcgagactcagtctcaaaaacaaacaaacaaaaaagacatttttgggaaaatttttaaattttggaaaattgtaaaatttgaacacagactggaatattagtttctattaagaaataattattaagttttaggtctgatagtaatattgtgattagttagggaactatctttgttttgtaaaggtgcattctaaagatatttcataatatcggtaattactttaaaataatttagcaaaaaatcaagaaaatatattaaaatgttaacaatgattacatctacattacatctgcatatccatgggtaatttttatattgttctctctatttttctgagtaattgaaatttctatttaaaaagtgtatcttctacttctactagatattgttgtatctgcatatgatcctggaaattgaggcagccatcttcataccatcagaagagcaggtgtgcaggggaaagctggcatgctaaagatggaagagtaggaagatggaaaatctgagcccctgatgacattgttgagaaaaccctgggcatcaacctctgggcttcctaaaatgtgagataatacatttttcttattatttatgccattttgaattgcattctgttactacaaaacctggcagacacacaacaaagaaagaatacttcaggccaacatctttgattaacatagatgcaaaaatcctcaacaaaatggttgcaaattgaatccagcagcacatcaaaaagctaagtcaccgcaattaagtaggctttatccctaggatgcacaattggttcaacatatgcaaattgataaaaattattcatcacataaacagaactaaaaataaaaaccacatgatcatgattgtccacatcacaatagatggagaaaaggctttcaataatattcaacatttcttcatgttaaaaactctcaacaaactgggcattgaaggaatatacctcaaactcagagccatccatgacaaacccacagccaacattatactaaatgggcaaaagctggaagcattccccttgaaagctggaacaagacaaggatgtccactctcatcactcctactcaccatagtactggaagtcctagccaaagcaatcaggcaagagaaagaaataaaaggcatcaaaaaggaaaagaggaagccaaactatctctgtttccagacaaaatgggtctatacctatataaccccatagtttctacccaaaagctcctgatctgataaacaacttcagcaaagtttcagaatacaaaatcagtgtacaaaaatcagtagcatttctatacaccaacaacatccaagctgagtaccaaaccaataatgcaatcccattcacaatagacacatacaaaaaataaaatacctgggaatacagctcaccagggaggtgaaagagctctacaatgagaattacaaaacactgctgaaaaaaatcagagacaacataaacaaatgaaaaaaaaatcccatgttcatggataagaaggatcaaaatcattaaaatggccatattgcccaaagcaatttttgaattcaatgctattcccatcaaactaccaaagacatttttcacagaattagaaaaacctattctaaaattcatatggaaccaagagagagcctgaataaccaaggaaatcctaagcaaaaagaacaaagccagaggcatcacattacctgacttcaaactgtactgcaaggctacagtaaccaaaatagcatggctctactataaaaacagacacatagacaaatagaacagaatagagagcccagaaaaaaaaaaaaaaaagagagagcccagaactaaagctgcacacctacaaccatctggcatgcatatgttcatcacagcactattcacagtaacaaagacatggaatccacctaaatgcccatcaattgtagactggacaaagaaaatgtggtacatccacaccacgaaatattatgcagccacaaataatgaaatcatgtcctttgctgcaacatggatgcagacggaggccattatcctaagcaaactcacacaggagcagaataccaaatatctattgaatgttctcacttataagtgggagctaaacatcgagtacacagagacatcaggaaaagaacaatagacttgacaatggaggatgggaggagggtgagtaccaaaaaactacctatcaggtaccatgcttatcacctaggtgatgaaataatctgtataccaaaccccagtgacactctatctatataacaaacctgcacatgtaccgtgaacctaaaagtctaaaaaagaaattattgcctgaccacaatagaattaatttagacaccaatttttaaagatactagaaaatctgtaaacatttgtaaaagccatatcttctaaatacatcatgggtcaaaaaagaagtcacaagaaaattagaaaatgttttgaattatatgataacgaaaacataatgtatcaaaatgtatatgatttctctaaagcagtacttggaggaaaactttcagatttaaaatgcttatattagataaaagagtttctaccttaagaacctagaattttaaaagagcaaaggtcaaataagttgaaaacagaaactaataaaaatgaaagggggaaatcaatcaaatagaaagcagaaaaacaaacagtaaaagttgcctgtctatgtgattaataaaattgataaacttctagctggtctgataaagaaaaaactgaggaacataaattaaccaacatcaggaatgaaagtgagagtatcagtacagattctacagataatgaaaaggtaataagggaatagttaaacaactttatgccaataaagttgaaaatatagatgaatttttaaaatccttgaaaaacataatttataatttatgaaaactaactaaagacattgaaaatatgaaaagatttacctattttagggaaattattaatataacctttcctgcaaagaaaactgaaggcaaggttgacttcacttgtgaatcctatcaaacatctaagaaagaattatagcaatcttacataaaatctttcagaaaaatatgaggaataagacattccaattcaatttattaggccagaataatcctaattccaaaacctatgcatagggtatatttgaatatgctctcttcaggccattgcttgtttataaatttcagaccaatatgaataaagcccatgtaaaatacttgaagccaatgtaatttttccagccctagcttgcaatactttaatcataagactgttggtcatgacattggtctttatcaaaaaacagtaccaaagggagcaacagtgatacaactttatgagtttctcataatttagtcattaaattttaaagaaatgatttctccccaacaacaaaaccagtagaaagctttatccatgccaaaagctcagaaattagtaaaaacgttaatttttcttgccctcctatagaaattccactcatgcaatcaaactagcttatccaaaatgactgttatgtgccaatcaagcggaaaagtcaactttgcatcagaaataagatacaggtatttcctatgtatctctcctatgttttacaggaagaattccgatagcaacaaacttccctcccaaatacagcacagtcgtctctcactatatgtgggaaattagttccagcacctacctaccaaaatccgtgcatactcaagtcctgcagtgggccctgcagaacccgtgtatactaaaattcaacctgactacatagggttcacatcctgtgaatcatgtatttttgaagcacatttggttaacaaaacctgtatataagtggacctatgtcgttcaaatccatgttgttcaagggtcaagtgtaaatgacagggtttagtacttagcagtgactccacttcagccaagagtagctggctactttgtaagcatcagaaaagaaacacccacagggggacacccactgtactatgacatccaaattgtattttgacaaaaaaatatttcacaaatgctttctttctgtatttacaagagattcatactagatgagaaaacagcacatacctcattgaattgtggttaactggtgttttgggaaatataatgaaaggtgattttgactacttttctttgcataggttttaaacataaccatgtaagaggtttacagggagccagctagaaggtgtttgtcaaaaaaaaataaaaagatatctgtgcatctgtgtgtgtgtatgtatgtgtgtgtttcagcagagctatttcttattacagttctgaaattttttaaattaaaagacaaagaacgacactacctagaagtctagcatgaggacaggaagttgtctggaatttacttaccaaagtgattttatgagaagtaacttgtgaagacttgggttaaaagtaatggaatcaatgccaaattccatacctagaagtttgttgcaaggaacattttggagaggcatgcaatgatttatatgcaaaaacatttactgttgtgttacttaaaatagaaacttactaataatagcctagatgagcaaaattagaaaaataacacagttaactacatgaaaaatatgcagccactaaaaatcatgcttcagaaaacacacacacacacacacacacacacacacacacacacacacacacacacacagggttgcatagcatccctcaaacttaatgtcaacccagaacatgggaataagatctgatttggaagtacaatctttgcagatgtagtgaagttaagatgaggtcatactagattaggataggccctaattcaatgaccagtatcctcataagaggggaatttggacatagacacagaaggaggatgtcatgtgaagacagagacagattagagtgatgtggatgtcatgtgaagacacagatagattagattgatgtttatacaagccaaggagtgcaaaggattgcattagaagctaggagagaggcatggaacagtttctcccaagcttccagaaggaaccagccctgcccacgtattgattttgtacttgtagcctccagagctttcagaaaataaatttgtgttgcttgaagccacgcagtttgtggtaatttgttatagtagctctagggaacaaatacagtgtgcacgcacgtgtgtgtgtgtgtgtctatcatgttataatatagctttgaaaagtatgatacaaaaaggaatgtacggaacttgggagcaagatggtggaatagaaagctccactgatcatcccccacaacaaggacaccaagttaacaactatctactcagaaaaaaacaccttcataaggaccaaaaatcaagtgagcagtaatagtacctggtttcaacttcatattgctgaaagaggtactcaagagatagaaaaaacagacctaaatcactaacgccaccctttccccacccctggcaggagcagcttggtgcagagaatgtctctgggcgctgggggagaggaaacacagcaattgtgaggcattgaactcagtgctgtcctatcagagcaaaagggaaaacccgaacaaactcagctgacacccgcccacagagggagcatttaaaccagtcctagctagaggggtattgccaatacaagcgggcgaaacttgagtgccaacaaacctcaccaccgagggccaaggtgctctcaatctctaagtaaacttgataggcagtctgagccataaggactgcagtttgtaagcaagtccttgggcttaactaggcccagagacagtacactgcgggcgggggtgctgagacatactgagacaccagctggggcagctaagagagtgctagcatcatgcgtcccctaaccccaaggctgaacagttcgtggctccaaaagagatgcccccgttccaggccccggctcccagacatttctagacacaccctggaccagaagggaacctgctgccttgaaggaaaaaaaaaccccagtcctgccagcattaatcacctgctaactgaagagcccttgggcctttaataaccagcagtgatacccaggtactacatagaaggccttggtgagcatctgacactggctggcttcaggtgcgactcagcacattaccagctacagtggctatggggcaaaactccttctgcttgagaaaagcagagggaaaagtaaaggagactttgtcttgcacgttaggtaacaacaccactacgggtgggtagaccaccaagcaggctcttgggatccccaatcccaagacttgactactggatggcatttctggatctgccctgggccagagaggagcccattgccctaaagggtaagtcccagaccaggcaacatttaccacaagctgacttaagagcccttgggccttaagggaacattggctggtagtctggcagtactactggtggccaggggcagcagtggctatgaggtgaggctcctctgcctttggaaagggaactgaagagtgacaaggactgtgtcttgtggtttgagtgccagcttagcctcaatacaatagaataccaggcagacttctgaggtttttgactctagtcctgactcctggatggcatttctggacccacctggggcctgggggaaacttgctgtcctgaaaggaagaacacaggcctgactggctttgctacttgctgattgtagatccccaaggccttgatcaaacataggcagatataaccaaagaaagatataaccaaataagactacctcaaagcatttaataatcaaaatcccaaaggtcaaggataaataaaggatcctcaaagcagcaaaagaaaagaaataaataacatacaatggagctccaatatgtctggcagcagacttttcagtggaaaccctaaaggctaggagagagagggatgatatattaatatttaaagtgcagaaggaaaattacttgtatcctagaatactatattcagtaaaaataccctcaaacatgatggcgaaataaacactttcccagaaaaacaaaagctgtgggatgtcatcaacaccagacttgtcctataagaaatgctaaagggagttcttcaatatgaaagaaaaggacattaaccagtaataagaaaccatctgaaggtatgatacttactggtaatagtaaacacactcccaaacacaaaatattataaaactataattgtgctgtgtaacctactcacatctttaatggaaagactaaagatgaacatataaaaaataataactacaagttttcaagacagacagtataataatagataaatcaaaacaacaaaaagttaaaaaagtggggggcgttaagtcaaaatgtagagttttcattagttttttctttgcttgttagtttgtttatgccatgagggttaagctgtcactagtttaaaataatgggctataagatattatttctaagtctcatggtaacctcaaatcaaaaagcctaaaacagatttttaaaaagagcaaaaaattaaaacatgccaccagaggccgggtgcagtggctcatgcctgtaatcccagcactttgggaggccgaggtgggtggatcacttgaggtcaggagttcaagaccaggctggccaacatggtaaaaccctgtgtctcctaaatatacaaaaaaaaaaaaaaaaaaaaattagctgggcatggtggcatgcttgtattcccagctacttggaaggctgaggcacaagaattacttgaacccgggaggcagaggttgcagtaagccaagatggtgccactgcactccatcctgggtgacagaatgagactctgtctaaaaaaagaaaagaaaagaaaaacatgccaccaaagaaaatcaccttcaaaaagggaaacaagtaggaaagaaggaagggaaagaccacaaaacaacagaaaacaaacaacaaaatggcaggagtaaatccttacttatcaataacattgaatgtaaaaggactaaattctccaatccaaagacataggctggctaaattgataaaaaaaaaaaaaaaataagacccaattatctgttgaatacaagaaacacatttcacctataaagatacacatagcctgaaaataaaggtatggaaaaagatattccatggccaatagaaaccaaaagagagcagaagtagctatacttaaatcagacaaaatagaattcaagacaaaaactataaaaagaggcaaagaaggtcactatataatcaaaaagtggccagttcagcaagaggatataacaatttaaatatatatgtccccaacactggagaacccagatctataaagcaaatactattagagctaaagagagagacaggcccccaatacaataatagctggagacttcaacaccccactttcagcattggacagatcttccagacagaaaatcaacaacaacgaaaaatggacttaatttccactatagaccaaatggatcaaatagatatttataaaacatttcatcgaatggctgaagaatacacattctttttctcagcatatgggtcattctcaaggatagaccataagttaggtcacaaaacaagtcttaaaacactcaaaaaacttgaatatcaagcattttctctgaccacaatagaataaaactagaaatcaataacaagaagaatgttggaaaccatacaaacacataaaaattaaacactaggctcctgaaggactgctgggtcaatgaacagattaagaagaaaattcaaaaatgtcttgaaacaaatgataatggaaacacaacataccaaaatctataggatacagcaaaaacagtaccaaaagggaggtttatagctattaagtgctcacatccaaagaagaaatacttcaaatgaacaacctaataatgcatcttaaataactagaaaagcaagagcaaaccaaacccaaaattagtagaaaaaaaaataaaagtcagagcagaaataaatgaaaaaaataatacaggagatcaatcaaacaaaaagttggttttttgaaaagttaaacaaaatagacaaaactttagccagactaagaaaaaaagagagaagattcaaataaataaaatcagagatgaaaaaggaggcattacaactgataccatggaaatgcaaaggatcattagtggttactatgagcaactatatgccaacaaattggacaatctaggagaaatggacaaattcctagacacacataacctaccaatgttgaactaggaagacatccaaaaccaataacaagtaatgagatcaaagccataataaaaagtctcccagtaaaaaaagcccaggaaccaatggcttcactgctgtattctaccaaacatatagaagaactaatatcaatcctactcaaactactctgaaaaatagaggaggagggaatactctcaaactcattctacaaagccagtattaccctggtaccaaaaccagacaaagacacatcaaaaaaagaaaactacaggtcaatatctctgatgaatattgatgcaaaaatccttaacaaaatactagcaaacagaattcaacaatacattaggcacatcatccacgatgaccaattgagatttatccctggatgcaaagatggttcaacacatgagaatcaaacaatgtgatacatcttatcaacacaatgaaggatgaaggataaaaaccgtatgatcctttcaattgatgctgaaaagcatttgataaaattcaacaccccttcatcataaaaaccctcaaaaaactggggatggaagggacacatctcaacataataaaagccttatacgacagaacgacagacccatggctagtatcatactgaatggggaaaaactgaaagccttctctctaagatctgcaacacaacaaggaaagccactttcaccactgttatttaacatagtactggaagtcctagctagagcaatcagacaagagaaagaaataaagggcatccaaactggaaaggaagaagtcaaattatccttgtttgcagatgatatgatcttatatttggaaaaaattaaacatgctactagaaaactattagaactgataagttcagtaaagttgcagaatataaaatcaacatacaaaaattagtagcgtttcgagctgggcatggtggctcatgcctgtaatcccagcactttgggaagccagagcaggtggatcacaaggtcaacagatcaagaccatcctggccaacatggtgaaaccccatctctactaaaaattcaaaaattagctgggcatgctggcgagcacctgtagtcccagctactcaggaggctgaggcaggagaatcgcttgaacccgggaggcggaggttgcagtgagccaagattgcacctctgcactccagcctggcgacagagcaagactccacatagcaaacaacctaaaagtgaaagcaagaaagtaatcccatttacaatagttacaaataaaattaaatgcctagagattaacttaggcaaagaagtgaaagtcctctacagtgaaaattgtaaaacattgatgccagaaattaaagatgacacaaaaaagtaaaaagatattccatcatcatggattagaagaatcagtattgctaaaaatgacccaaagcatactacacaaagcaatctacagattcagtgcaatccctatcaaaataccaatgacattcttcacagaaatagaaaaacaatcctaaaatttatatggaactacaaaacaatcagaatagccaaaactatcctgagcaaatataacaaaactggaggaatcatattacctggctttaaattatactacaaagctgtagtaaccaaaagagcatggtactggcataaaaacaggcacatagatcaatggaacagtatagagaacccagaaataaatccatacatctacattgaactcatttttgagaaacgtgccaagaacatgcattggggaaaggacagtatcttcaatacatggtactgggaaaactgcatctctatatgcaaatgaatgaaactagactcctctctcccaccatatacaaaaatcaaatcaaagtggattaaagacttaaatctaagacctaaaactgtgaaaccactacaaaacaaattggagaaactctccaggacattgcattggtcaaagatttcttgagcaatacctcacaagcacaggcaaccaaagcaaaaagggataaatgggatcacatcaagttaaaacgcttatacacagcaaaggaaacagccaacaaagtgaaaagacactaaatgggagaaaatatttgcaaattacccatctgacaagatattaataaccagaatatataaaaagctcaaacaattctagaggagaaaatctaataatctgattacaaatgggcaaaagatatgaatagagatttcgcaaaagaaaatacacaaatgcaaacaggaatatgaaaaagtgctcaacatcattgctcactggagaaatgtaaagcaaaaatacaacaagatatcatctcactccagttaaaatggcttttacccaaaaagtcaggcaataacaaatgctggcaaggatgtggtgaaaagagtaccctcatacactgttttggggaatgaaaattagtgcaaccactatggagaacagttttgaggttcctaaaaacactaaaaataagccagccatggtgacttatgcctacaatcccagcacactgggaagctaaggcaggaggattgcttgagcccaggagtttcaggctgcagtgagctattattatggcacttctctccagcctcggtgacagaaaaagaccttatttaaaaaaaaaaaaaaaaaaaaaagaactaaatgctaaaaatagagctaccatatgttccagaaatcccactcctaggtatatatacccataagaaaggaaatcagtatatcaaagagatatctgaactcccatgtttattgtagcactattcacaatagccaaaatttggaagcaacctaggtgtccatcaacagataaatggataaagaaaatggggtacataaacacaatggaatactattcagccataaaaaagatgaaatcctgtcatttgcaacaacatggatggaactggagatcattatgttaagtgaaataagccaggcacagaaagacaaacttcacatgatctcacttatttgtggaagctaaaaattaaaacaattgaactcatggagatagagagtagaaggatagttaccaaaaggtgggaaggggagtagaggagtgtggggggaaagtgggaatggtagtgggtacttaaaaacatagaaataatgcataacgcataagaccttgtatttgccatcacaacaagacgactatagtcaaaaataatttaactgtgcattttaaaataactaaaagagtataactggattgtttgtaacacaaaggataaatgcctgaggtgagggataccccatttaccttgatgtaattattatgcattgcatgcctatatcaatacagctcacataatgcataaatatatatacccactatgtacccacaaaatttttttaaataaaggatattacaaagcattaaaaaattaaataaacacaggggtacagatgtctcttagatataaaaaaaagtctagaaagaattcgtcattctagaggccattaagaacatttgtgattcatgggaggaggccaaaatatcaacaagagtttggaagaagttaattccaatcctcatgggtgactttgagaggaattcaagacttcagtggaggaagaaactgcagatgtgagagaactagcaagagaactagaagtggagcctgaagatgtgactgaattgctgcaatctcatgatcagccttgaatgtgtgagacgctacttctcatggatgaaaaaaaagtggttccttgagatgaaatatattcctgctgaagatgctgtgaacattgttgaaatgacaacaaagacttagaatatcacataaacttagttgataaagcagtgacaaggtttgagagaattgactccaattctgaaagaagctctgtgggtaaaatgctatcaaatagcatcacatgctacagagaaatctttcatgaaaggaagtcaatcaatgcatcaaacttcattgttgtcttattttaagaaattgccacagatacgccaatcttcaactaccaccctgatcggtcagcagccatccatatcaaggcaagactctccaccagttaaaagattacaactcactgaaggctcagatgatgattagcattttttagcaataaagcatttttcaattaagatatgtacattgttctttttagacataatgctgttgcatactcaatagactacagtatcgtgtaaacataatttttatatgcactcggaaaccaaaaatttgcgtgactcactttatttgtgtgactcactttattgtagtggtctggaatcaaacgtgtgatatctctgcggtaggcttgtgtatagcagagcttgacatttttattattgcactaagtctgattaacagcagcaaaactagaagcagcagggggcctgtatgtagcattctctcatgcagcagtttttgcaaattgaatccaccaaatgttagccacagtatagatagaaggaattttactattatatccgtgtttgaaccctgatttctaatatcagtttgagtatatcattctgtttctagaaaaacagaatttgcacccttgtttttagcggaggaataattttcagaatataaaagacaatgattaggcagattctgaagaaaataattttaaacacatgttcaaaatacttgcaggtattaaaaatagcaaagcttgctcaaaatgaagtgaaataagcttatgaaagacataaggttttaacaaagcagtccatgacaatcatttcaaatgcttgagagtctttctcagtaatttctgacttcagagtcatccgtgttcaatgctagagctagacctgttaagtatgattatcactatacatgttttaaattttttaaatgttctctctttgtaacagctttattgatgcaaaattgatatacaaaaatcacacatattttatgtgtacaacttgataagtttggacatatgcacccactagtgaaatgaccaccacaatcaagataataaacatcaatcacctccaaaagtttcttcatgcccctttgtggttttgtttttgctttttctgtaggaacacttaatgtgagatctaccttcttaaccaatttttaagtgcacgactcagaattgttatccatagaaagtatgatgtacagctgatctctagaacttaatcatctttcataactgaaactttatacacttttatcaactctccttttcctcctctcaatagcccctggcaactatcactctactttctgttctatgagtttgactactttacatacctcatataagcggaatcatgcggtatttttcctactgtgactggcttatttcacatagcataatgtcttccaggttcatccatgttatcacatgtggcggaatttctttctttttaaggctgaataatcttccattattatataacattatataacacattttttctttatccattcatccactgatggacatttacgttgttttcaaatcttgcctatcatgaataatgctgcaatgaacatagaaatgcatatatctcttcaagatcctgatttcaggccaggtgcggtggctcacgcctgtaatcctagtactttgggaggccaaggctggtggatcacctgaggtcaggagtttgagaccagcctggccaacatggtgaaaccctgtctctacgaaaacacaaaaattagccgggcatgatggcgcgcgcctgtaatcccagctactgaggcgggagaattgcttcaacccaggagacagaggttgcagtgagccgagattgtgccattgcactccagcctgggtgacagagcgatactccatctcaaaaaaaaacaaaaaaaaaatcctgatttcaattcttttcgatatatatctagcagggagactgctggatcatttggtagttctgtttttaattttttgaggaaccttcatacttttctccatagttactgagccattctagattcctaccaactgtatataagggtttccatttttccacatccttgaaaatatttcttttttttttaaataatagccatcctaacaagtgtatgatgatatttcaatgtgattttaatttgcatttccctgatgattaatgatgttgagcaccttttcatataactgttggtcatttgtatgacttctttggtgaaatgtctattcaagtcctatgcccactttttaatcagatttgggggtttttgctcttacgttgtagaaaatttttatatattttggatgttaacctcctatcagataaatgatttacaattttctccctttaggcaggttgccttttcactctgttgattgtgtcccttgctgtacagaagctttttagtttgagatagtcctacttgtctagttttgtttttgttgcttgtgcttttggtgtcatatccaaacaaccattgccaagaacaatatcaagcttttcccttctgtcttcttctacttttacagtaaactaaccccctgttgagcaattgggtttttgctttcttaaaaccctctttctttggattctgggacttcaccttctcctcaatcttttactacatttataaggaacttcttagtcaagcttctagtgattcttaactgggcttaggacacgcccccctccctcctcatcctggtggaaagcatcagcaatcagcaacatgagatcagagtgttgcacaaaagaaaagcatggagacagaaaaacagattggggagtatgccctgcgctcagcccctcaaacatcccatctactcctctagttttaactattctctgatttccaaacacatgtctctactccagacttacttagcagttatccaaggttatatagcagtctagttatctgttaggggtgctacaacctcaaaatagcaaaaacataaaatcattctctcttcccatccatcttcccaacatattctcttttatatcttctatattttagtaataatttctcagatattgtcttgccaattctacttcctaattatctcttgaatctgccgctttctcttcattctcacttagtttaagcaatttttagctcttgtgtgggttctttgcatagctcctagttgctttctctacctccagcctcatataaacacaactccacccctctcttccagtgcatctcttacatcattcctgaaaagttctttccaaaatgcaaatttgataatatctctttcctaggtaaaattatctagaagcttatgattccctacaggataaaaatcaaaccaacttccttagcagaaggtataagaccttttataatttggagcctaactacccaccatctctcatcttctattccaacttcaaaaccctactcagatgtcaacttctctatgaaggtcttctaaccaatctctctcccccaaaattaggttaggccctcctttctctatagcatgtacctaatacttttatcattgctaaaataaattataatttatttgtgtatacatgctactcatctaagaagatgagctccatgagaaaacagattatctatttttcctcttgacacacttagcacttgttttcaatcccagatgatggatggatggatgattaaagtacagaagaaatcaattagtgagccagtatgatagtttatttttctaaacattccaactggatttcctaatagtcccaaattaaaaagttcttgctagccacgatcatttgagtaactgaaacagctatactggcatctattctgacaataactttaaaagaaaaataaaaccttgttatatatatgcagctttgggtaataaccttgaaaacatgccatgaaatttcccccatttaaaaaaatcccaatgatgagctctctgccatagtaataaaattctggtaaacaccgtgaccatttatttaggaaaatgagtttgcagcctcaagggttacattcaaatggagaaggaatcaatgcagccaagaagaaaatccctgccacacttaagaggactaaaaactttatcactctggaatattccaggtcaaattcaagatgtaccattttttgacattttaataggtgcaaattaagtagggttatgggcacatttcacataaagtgagatttcctacaatcagaccacaataaaactctttttctctagtaaaaacttagatttaagaacctttatactcccatatacatgcacaatattaaatggactcagatgagagaacagcaaagctaatctgtgcagataaaagaatgagtcaaagaaagacaataactactgttgtttttcaaagtaagttaagtttattatttctgttgtctgtcatcatcaattgcaatgaggatatagaccagcagtctgggaaatattctctaatgagccagaagcccctgcttggctatatctaacttggactctgacccacactgacaagagaaacaaaatttgcctgaatatttcaaacaccacaaagataatgaaaaacctaagccaaatttcagtcattgccccaacagagttgataatgtcatgcagtgctgacatgttcttggaattgtaaagcaataaaattatttgtcaaaattgagccttttctacatgtctcaaattgtgtcttttacatttttttccataatttcctggcttctttgacagctttaaattgtacataattttcatgtacggtacgttttgaaacacatggatgtatacactgtgaaatggctagatcaatgtaattaacacgtattacaggaggaataagttcaagagaacttgtacaacatgttaattatagttaatgataatgtattattttcttggaaattgttaatagattttaaatgttctcaccacaaaagtgctaagtatatcacattgtgttattttatgtcttcctacagctcaagcaaattttacctttttatatttctgaagtcattggtaaccaagtgcttcagtcagcatcccaacaggttggcatactcaaattaggttaacttgaggagaatttattttaaaaaaggaactcttttaaggagtatgggcaaaatgccaaggaactagaagtatcacagagctaataatataggagcagttactaaaccctaggcccaaaggaaaaagggaaaggagtagtttccagaacctaaaaggagagaatagtatgcaagtggacaccttgaaaaggttactgaacttcagtaaacgttctcagacagcccaaggtgaccttacagggagggagccaagggataaataattgatctcactctcctctctctctctatctctctctcacctatcactggggcccccatgagcaaaaccaacctggaagccagagaaaataagagctccttgatgaagttcatacagattagcatcccaggccagagaacaaggtgaagacaagaggagaatggctctgaagggacaaattaaagctatccaacactccatgttttatggagcaagtttcttctcccatccatcatctacatctatttagtgactactgcatgcaatatacagtaaattataagaacatggtgaagatgtgggaaaaggaagttgaagatagagagagagtcacagaaaaatctcctacaggaaattaaaattaaaacatgtttctaaccatggcaaaactcaattaccatatctacaagtaaaaatctacccaaagggctgtctgtggatcagtagcatcagcatcatctgggaacttgtgagaaatgcataatctcaggctccaccccagacccactgactcagaatcttatttttaatcaaatccccaggtgcctattatgcacattaaagtttaagaagcactgctgtaaagactccctaaatttactcagggtaatactaaaagtttggagtaattaaagctagtgggatttaacatgggaaagttcaagaaggtgttatattttagaagtttattagaatagcattttactgaaaacatcatgtttttacatttaatcgtaaagtcaaatggcaaatatacttaattagtaactggatatataatattcatgaaataatattatcaaaactgatagtaaatattgttccattaatacaaagttctttggggataaaaaaaaattcttatgctacataaattctctaagttctctaaagaaaggaaaaatccaggctatttaaattggaaagctgctgcttcagttttgtgctttgctgtcattctcgacttaatactattttcctttctatttcaggatcaactctgacacttcatgggtgttcagtaaacactttttgatcgattgaagcccaactgttttaaaattgtatgctaaactataataatagatcagcaccaaaatctagttgcagactgtcttctctacctaaagaacagcaccatctagtgtttgcccaacaatgttccatcttctatcaagtgtatctttactaagccatatgagaaaattctaatgttaaagttaatccactgtgtcataccgttctaccttactacatatctaacaaagtcttagaataatttaagtttgcttttgccatgcatcagttctagctttaaaatagcagcagcagcctggagcactggctcaggcctgtaatcccagcactttggggatgccgaggcaggcagatcacgaggtcaaaaaaatcgagaccatcctggccaacatggtcatctctactaaacatacaacaaccccatctctactaaaactacaaaaattagccgggcgtggtggcgcgtgcctacagtcccagctactcaggaggctgaggcaggagaatcgcttgaacccgggaggcagaggttgcagtgagctgagatcctgccactgcactccagcctggcgacggagcgagactccgtctcaaaaaaaaaaaaaaaaaaaaaaacaaaaaaagcaggagcactatttcatacactacggaaagacaaatttacctcaacatctcagtagcccagcccacatcttcttacttcaatccttatcaactcagtgcataccatctgatttcccacttcaagaacctatcggccatgcctgaggactttttcaggccaccaaaaaccaccttgctgctcacactgcaggccagacctagattaaccctgccctcagaagcccccagccaagactaatgagagatgatgcataaacatcccagcttcctatcccctcaggagacaggctctgtttcctagagttttctcataagacgaagtgccaatcactcacaacggtgactcttttggctgccttctcttcccagtctcactttcctactcccctagcaatgtttccctcacctccagataaactacttgcactgcattcttacgctgcagtctgcttctgggaaaacccaaattaagacattcttactgcaccatatcccatcgaaagccattggctaagaagacaagtagagaagaagtgttccatgcctggttcatcatttgctaccctcccaccaccccacccagttcaccaacctaatatataatcacggcatcacaggaatattacataacagcagagactttgctttattcactgctgtattacaacacctagaacaatgcccacaaatagtaattgctcaataaatatttgctgactacaagttaatgctggacataaatatatctctgagctttgaaagaagaaagtcaccaatggtgaccaagattttatgtacaaatattaatttattctcttttaatttccaatattttctaatatgaaaacttttttagcaaaactcagatctacggatccatacctgatgcgccaagccagtcagaatacctgtcactggaataaaagtacattacaaatctaagcatttgtgagtatatgaaaattaagatagttattttcggggctcatgttttgccaaattaacattttaatagatactaatattagaaaggagctactatgaaaattttaatttatgcctaaagctacatgtgtttttctaattccttttccttcttttctctacaaaataaaacatggttttcaatggattatgtcatcaaattcaacgtgaactttagattttttttaatattggtcacaatgacacattaaagtgttctagcacatgagatgtttccctaatcaaaggatattgtaagattaatagagaaaaatgactcaactctgaaagtttacaccaggacaggttgaacagatagaggatgcattttcttttactcaggacagctgtaaggaatgctagattccagtgaccactcatcagggaaagtgaggtaaacaaggattaggtagtgcctaggagatttgggctctcaaggtgtgatctatagcccaattgtcacagtccaaaaagtcctctacccacatagataccaataatcaaggatttgtacatgatgggtagagtctgacacatagcatcttcttggctcaggagcggggttgtaagcctgggtctaagcataacagaggacagacatatggctacagggcaagggaagattggcaagggtgggctctaggcagattcttaggaccttaactaagcagcctagcatgcagaatagggcggctcagcccctaagaagactttttatgcaaaccaggaattagaacaggccatccttgttgaaggctgggacacatggctcagtgggtgctcttaatctggttccaggaagacctgaaaccaggaagaaacatatattaattccaaatgccctctgatggggatgagaatcaggtttggaactcatgtttacagtaactgagacgagctaggtctaaaggttaaaagccatcacattctccagctggacagagacaaaagggcattaggaaataggtagaaggtggcaaattgcctttctccagctactttcccctagataaatcctataaagacctatatttctttaaaacaaggatttagcaaagggaatggatttagggtgagagatgagtttgattgttattgttgcaggaatcagaggaccagagagaccaatggatagaacaggaggattttatttaagtggccactggcccagtggattcacatccaaaggctaggccctgaacaaagacagggctttacttttatacacactcttgaaagggagttggctagtttgaatggcatggtgggaagccaatggcgtgaaactcgtggtgcaagcaagcaggcttacagaagcagaacaaaggcagttattcaaacagtgacaggtttcgtttccctagcatagcctgtgaccttgcagctgcgtcaaatgaaaaacagaaacttacaaaacttgggaaattgagtaatggtaagcgggatgcagagatagtaaaggaatttgtctttcctaaccttgctctgagggggtgtctggggcccattcctttcggctttggcttttcagatagtgttatcaaagctttgccagggctctatctattactgtccttggagtgagttagctaagtacaggaaaacttgtttgtctctttttaactcctgcttcattatcttcatgaggcctgttaaattatttgaggataaagcaccttcagagcccactgagtttcagagctatgctccagaacacagaagaatctgttactcatatctactcacccatctgaacctgatggtgaacctttcttcagctttgtcctgggctaggaaattttacattttaattttaaaaaagaatagtacaccttccaaattgctacatatgccctgaactgaatacaaatcaaaggctcatgctgcatctggaaaacacacattaataggaatgttcatttgtttggattatttccttccacgtgatctgaatgggccccaagcattccaggatcacatcagtcacaactaaggactgttcaagggctattccttccagtttcatataatgaaaccaggttcaaggtcaacttcaggcaagaatatacatgaggcatcttctatgtaaaagatatacacatctcaccttaccacgatccatttgcccctttctatcccaaccaagaaagtctgagctggagtttttcaagttaaaatgtcttactctgacttggttattttactttgggtaaaaaaagagacacattaagagcacattttagaatggcagtgatagaatttttttacattttcttaacgcatttacgctttattctctgagtgctaataactaaggcatgataatttccatttgattccgcttattatttctcctgagtaaacaaggtagaaaatggtaaggctaaccattttggtctattcaaaataagaccaggatctcagcctaagttagattcttattaaaactcaaactctgaacagaagaaaagtttaaaggttgaacaaggtacgtctcaaaccatgtctcccatcttcagcttagtccactgatatatctaatgatccagacacagaaccaaaggaaatgcagtctactcatttgggacaaggggagtcaattggatactactatggtccaggagactgaacttgttaaggcaactgttatcaagtacagcagtccaagaccttccaagacctccagtggatgcctgaagtctttgatagtactgaaccctgtatatactatgcacgaatttctttcctcttcacaatttcatggacgattcattcttaccatggatctcagtaacctcagcatataattttttttgtttcttcattaagttgaaagctttcaccttttcacttaaaggaactactttttggcttctctttggcatatccaaattgccaacattactacttttgctctctggggccattattaagtaaaataaaggttacttgaacataagacctgtgatacctgacactccaactgataacccatatggctaatgggcaggtagcatacaaaacacagatacactggacaaagggatgattcatgtcctgggtgggatgaagtggtacaacatgagatttcatcatgcttctcagaatggcatgcaattcaaaatttacaaattgtttatttctggaattttccatttaatattttcagaccgtggttgaccatgggtaactgaaactgtggaaagcaaatctgtagataacggggaatgattgtatccaaaagcaatatgctcatgggaaatgttacaacagacgcttctaactgtcccccttctcactcatggtaagggaactcctgctttttagatggatttatggcatccccaatttaagacattcccatactagtctgcaggtaggtgtggttccatgtgtctatgttgtagtcaaggaaagattagctagagtttacatctttggggtcatgtccttagtgtcaaggacatggcctccactgccattttatacctttcttgctggctgaaattcagacattaggagagtaatcttggaccatgtgggataaggtcaatattctaaggatagcagagcaacaagatggagggtgcctgggcccttggtgacatttcagtagagagctgccataattgctcagattttactttgagaaagaaatgagcttctgtcctctttaaggcatcgttgattttaatctctgttagagcagctgaatgttatactattacaattgtatggcaaataatttgctactaataatattttaaggaaggaagtatgattgtgagttatttattttggtataagttagagaagttatcctattacaacattacttgcactaacatggattccaaaatgttttatagagcaagagaaaaggagtgtcattgtatgtagcatgtcaagaattgtgcaaattccatggtgccccattggatatgttcaatctgtgaatgccatctgttatgtgtactatagggtaaaaactgttagattggtacaagaggctaagaaaatcataatataaaccatgttaatacctatgtatatttgcctttatactcagattgtattcctcacctcatttataaatttggctaattcacatcataaggtaaaaccagaaagagggctagatacaaaacaatcgccatccttagaagggccacatggggcaccagacctactagtgggaaggcagcttaatgacagccaaaatgacataataagagcataatgagccaaccaataaaatgcatgttttgcttaaaaaattatcaagaaataaaaatagacatataagagcctatatgagagttaacaaacattcttctatgcacactattagtagaatgtgagtgtagtttattacaaagaaatagacaaatgcacaaagatgtaaagagttaagttgttactcatggtgctattcatactagtgagaaattagatgtaatctacatgtccaacaactaagaattagctaaataaatttggccaattcctgtgatggaataattttcagccattaaaatagaatttttgaaggttatttaattagataatattgacaatgcaggtttaacaatatgtgcactataatctcgatgttgaaaaaatcatactgtacagatacaatatacatttgtgtttgaaaaattttctttttatactttaagttctagggtacatgtgcacaacgtgcaggtttattacatttgtatatatgtgccatgttggtgtgctgcacccattaacctgtcatttacattaggtatttctcctaatgctatccgtctccccttcccccacctgaaacaggccccagtgtgtgatgttccccttcctgtgtccaagtgttctcatagttcaattcccacctatgagtgagactatgcggtgtttggttttttctttttgcgatagttggctgagaatgatggtttccagcttcatccatgtccctacaaaggacatgaaatcatcattttttatggctgcatagtactccatggtgtatatgtgccacattttcttcatccagtctatcactgatggacatttgggttgcttccaagtctttgctattgtgaatagtgccgcaatacacatacatgtgcatgtgtctttatagcagcatgatttataatcctttgggtatatacccagtaatgggatgcctaggtcaaatggtatttctagttctagatccctgagtaatcgccacactgacttccacaatggttgaactagtttccagtcccaccaacagtgtaaaagtgttcctatttctccacatcctctccagcacctgttgtttcctgactttttaatgattgccattctaactggtgtgagatagtatctcattgtggttttgatttgcatttctctgatggccagtgatgatgagcattttttcatgtgtctattggctgcataaatgtcttcttttgagaagtgtctgttcatatccttcgcccacttgttgatggggttgtttttatcttgtaaatttgtttgagttctttgtacattctggatattagccctttgtcagatgagtagattgcaaacattttctcccattctgtaggttgcctgttcactctgatggtagtttcttttgctgtgcagaagctctttagtttaattagatcccatttgtcaattttggcttttgttgccattgcttgtggtgttttagacatgaagtccttgcccatgcctatgacctgaatggtattgcctaggttttcttctagggtttttatggttttaggtctaacatttaagtctttaatccatcttgaattaatttgtgtataaggtgtaaggaagggatccagtttcagctttctacatatggctacccagttttcccaggaccatttgttaaatagggaatcctttccctatttcatgtttttgtcaggtttgtcaaagatcagacagttgtagatatgttgtattatatctgatggctctgttctgttccattggtctatatctctgttttggtaccagtaccatgctgttttggttactgtagcattgtagtatagttggaagccaggtagtgtgatgcctccagctttcttcttttgacttaggattgtcttggcaatgcgggctcttttttggttccatatgaactttaaagtagttttttccaattctgtgaagaaagtcattggtagcttgatggggatggcattgaatctataaattaccttgggcagaatggccattttcatgatattgattcttcctatccatcagcacagaatgttcttccatttgttcgtgtcctcttttatttcgttgagcagctgttggtagttctccttgaagaggtcctgcacatcccttgtaagttggattcctaggtattttattccctttgaagcaattgtgaatgggagttcactcatgattttgctttctgtttgtctgttattggcgtataagaatgcttgtgatttttgcacactgattttgtatcctgagactttactgaagttgcttatcagcttaaggagattttgggcagagacaatggggttttctagatatacaatcatgtcatctgcaaacaggggcaatttgacttcctcttttcctaattgaataccctttatttctttctcctgcctgattgccctggccagaatttacaacactatgttgaataggagtggtgagagagggcatccctgtcttgtgccagttttcaaagggaatgcttccagtttttgcccattcagtatgatattagctgtgggtttgtcatagatagatcttattactttgagatacatcccatcaatacctaatttgctgagagtttttagcatgaagggctgttgaattctgtcaaaggccttttctgtatctattgagataatcatgtcgtttttgtctttggttccgtttatatgctggattacatttattgatttgtgtatgttaaactggccttgcatcccagggatgaagcccacttgatcatggtggataagctttttgatgtgctgctggatttggtttgccagtattttattgaggattttcgcatcaatgttcatcagggatattggtctaaaattctctttttttgttgtgtctctgccaggctttggtatcaggatgatgctggcctcataaaatgagttagggaggattccctctttttccattgattggaagagtttcagaaggaatggtaccagctcctccttgtacctctggtagaattcggctgtgaattcatctggtcctggactttttttggttggtaagctattaattattgcctcaacttcagagcctcttattggtctattcagggattcgacttcttcctggtttagtcttgggagagtgtatgtgtccaggaatttatccatttcttctagattttctagtttatttgcatagaggtgtttatagtattctctgatggtagtttgtatttctgtgggatcggtggtgatatcccctttatcattttttattgcgactaattgattcttctctcttttcttctttattagtcttgctagcagtctatcaattttgttgatcttttcaaaaaaccagctcctggattcattggttttttgaagggttttttgtgtctctatctccttcagttctgctctgatcttagttatttcttgccttctgctagcttttgaatgtgtttgctcttgcttctctaattcttttaattgtgatgttagggtgtcaattttagatctttcctgctttctcttgtgggcatgtagtgctataaatttccctctacacactgctttaaatgtgtcccagagattctggtatgttgtgtctttgttcttgttgatttcaaagaacatctttatttctgccttcacttcgttatgtacccactagtcattcaggagcagtcattcaggagcaggttgttcagtttccatgtagttgagcggttttgagtgagtttcttaatcctgagttctagtttgattgcactgtggtctgagagacagtttgttgtaatttcggttcttttgcatttgctgaggagtgctttactttcaactatctggtcaattttggaacaagtgtgatgtggtgctgagaagaatgtatattctgttgatttgggatggagagttctgtagatgtctattaggtccacttggagcagagctgagttcaattcctggatatccttgttaactttctgtcttgtggatctgtctaatgttgacagtggggtggtaaagtctcccatttttattgtgtgggagtctaagtctctttgtaggtctctaaggacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggattgcaacccctgactttttttgttttccatttgcttggtagatcttcctccatccctttattttgagcctatgtgtgtctgcacgcgagatgggtttcctgaatacagcacactgataggtcttgactctttatccaatttgccagtctgtgtcttttaattggagcagttagcccatttacatttaagattaatattgttatgtgtgaatttgatcctgtcattatgatgttagctggtcattttgctcgttagttgatgcagttttgtcctagcatcgatagtctttacaatttggcatgtttttgcagtggctggtatcagttgttcctttccatgtttagtgtttccttcaggagctcttttagggcaggcctggtggtgacaaaatctctcagcatttgcttgtctgtaaagtattttatttctccttcacttatgaagcttagtttggctggatatgaaattctggcttgaaaattcttttctttaagaatgttgaatattggcccccactctcttctggcttgtagagtttctgctgagagatctgccgttagtctgatgggcttccctttgtgggtaacccgacctttctctctggctgcccttaacattttttccttcatttcaactttggtgaatctgacaattttgtgtcttggagttgctcttctcgaggagtatctttgtggcattctctgtatttcctgaatttgaatgttggcctgccttgctagattggggaagttctcctagatactatcctgcagagtgttttccaacttggttccattctccccgtcactttcaggtacaccaatcagacgtagatttggtcttttcacatagtcccatatttcttggaggctttgttcacttctttttattcttttctctctaaacttctgttctcgcttcatttcattcatttgatcttccatcactgataccctttcttccagctgatcgaatcggctactgaagtttgtgcattcttcacgttgttctcacgccatggttttcagctccttcaggtcattttaaggccttctctacattgtttattctagtcagccattcatctaatcttttttcaaggtttttaacttctttgcaatgggttcgaacttcctcctttagctcggagaagtttgatcgtctgaagccttctctcaactcatcaaagtcattctccgaccagctttgttccattgctggtaaggagctgtgttcctttgaaggagaagaggggctctgatttttagaattttcagtttttctgttctgttttttccccatctttgtggttttatctacctttggtctttgatgatggtgacgttcagatgggttttggtgtagatgtcctttctgtttgttaattttccttctaacagtcaggaccctcagctgcaggtttgttggagtttgctggaggtccactccagaccctgtttgcctgggtatcagcagcagaggctgcagaacagcggatattgctgaacagcaaatgtctgatcattcctctggaagtttcatctcagaggggtacctggccatgggaggtgtcagtctgcccctactgggtggtgcctcccagttaggctactcgggggtcagggacccacttgaggaggcagtctgtccattctcaggtctcaaactctgtgctgggagaaccaccactctcttcaaagtggtcagacagggacatttaagtctacagaggtttctgctgccttttgtttggctattccctgcccccagaggtggagtctacagaggtaggcaggcctccttgagctgcggtggcctccacccagttcgagcttccccgctgttttgtttgccaactcaaacctcagcaatggcaggtgcccctcccccagcctcgctgccgcactgcagtttcatctcaaactgctgtgctagcaatgagcgaggctccgtgggtgtgggacccctctgagccaggtgcgggatataatctcctggtgtgctgtttgctaagaccattggaaaagctcagtattagggtgggagtgacccgattttccaggtgctgtctgtcacagctttgcttggctaggaaagggaattctctgaccccttgcacttcccgggtgagacgatgcctcgccctgcttcggctcacgctcaatgcgctgcacccactgtctgacaagtcccagtgagatgaacccggtacctcagttggaaatgcagatattacccgtcttctgcgtcgctcccgctgggagctgtagactagagctgttcctatttggccatcttggaaccgcctcctgtatttgttttaagctagaaattagtccagatagtcttgcccactactgccagaaattgaaagtcttaccacctaatatacagactgttgaacagtacttttggttttgaccctgccttcactcctattactaaagatacctccagtgtttctagttataacaggaaataaggaaagaaaacaggatcagagattggcagtttacagatttgatggtggggctggtggaattcctgtatgattcattttctcaatgtggtttgaagtgaagttattagttcagagtaggaaaaagaagaaaaaggagagatatgaaatagtcatctcgaagaatgaaaaaacaagctttctattgaaacttaatgtcattttccatctacattgctatggactgagtgtttgtgcctttgccccaaaatttatatgtcaaagtcctaatccccagtgtgatggcatttggaagtgagggcttttgtggggcaattaggtcatgagggtggagctgtcatgatgggattcatgtccttataagaggcagaagagagatgttgtctctctccaccatgttaggatacagcaagaaggttgcagtctacaaaccaagaagaaagtgcttgccagacaccaaatatgttggccttgatcttggacttttcagcctccgtaactgtgagaaataaatgttttttcaagccactcatctatgacattttgttatagcagcccaagttgactaagacaaacataaagtacaaatttgagttttgtgttcattaacagaaaatgggatgagtccaccaagtacgtgattgaattcatcacagtttagctatacagaagaaactgaagtttgggattttccaaataataacaatggcgagaagacaaggacattaaggttatttgcaagaatgtgatcatagtgaagaaccatggaatcgggctgagattaagacaagattaacagcaccccaaccccaaaagagaatgatgaggtcaatggatgagagaccttgatgaagtcaaatatcagctataattttggaagttaagcaagtaatctgaaactaaaggatacaggtatctgaaatggagctatttgaatttgagatgtcagggatgggtggttttggttaatgagatgttactgagcatcactttggaagtgggttgctaatacagagtggcagtaaaagcacactggtaatgaagaagttaatggattgagaccaagttgatgaacactgaattcatcaggaatgatgaaagtattgtaaataagagtgtgagaaagcagcatgaatgaggacaagacccagcacggttggtaagtgacagcactacaaaagaggatagagtagtataccacttccatgagccttagtagagcaggaggtttgcaagagggaggaggaaaggtggtctagaagctgtaatagaactactatccctcttcttgacctgaagtataaaaggtataagaaaataataataaaaaaaggtttcctcttgagaagaccacactagcttttataaatgcaatgactgaggtaaacagaatataaggcatgctaggatgactcctaaagtctaaaagagcacatgctctcagttttcttaattttttaggaattcaaattctttgtatgtaaaatgaagagataaaatttgatggtctataaagttctttcactctctgaaatattgcatgtgtcactttaaacatctacgattgagcaatgtgtattaccaggattaatattttcatgatctgtaacatcacgtcttgactcaaatctctattctgcacacttaagtttaaaagagcataagttcacaatgttaggtagtttgaacaaactgttactttttatggataggtcctaatactaatattttatgagatttcatctttggtttgttcttgccaatctctgcaactctgcagggtgtttttacacatatatcttttggcctcaattttgttaggtgctaattttaatgctcatttatcagttgccatgagcaaaacagtgacgagttctaattctctttctgtcatatccaagtggcctccattcttctcttacaaacagataatattttgactgtgtgaacattacaagtgcacctaaattctgccaaattccaaataatggcagtgtaactgtgagtgagtatagtctctctcagcttcattttataaagaatggttttctctaaatcagtgttttttcagctaaggattaagacccattagtgaattataaaattaattttttattaaattaaaagcttgtcaaaagtagcatttttagggaaataaatcaaaatagaaaaagaaaaaatattcaagtgcatataagagtaaaaattgtttcctgaaacttgttttcatatatatggctatttacagatataatatatatatatatttgtttctgtatatactgtgtatatacacacatatgtttaagtgtactgagtaataatgtaaaattcatttcttattgtgggttgtggtcaaaatgattgaaagccacaggcatagcaaaatgtgcaagtaggatttctacttcctatcctagaatatcccaagttccctcttgataccttgagagagcaagtgtactagtcagctttgcagcgaaacaatctcagaatgttagcaaattgcaaaaaaaaaaacattatttcttgctcatatcatgtgttgacacctgcaggtctgctgttgtagttccatatgtgttttcgttctgggatctagattgagggagaagctcctatttggaacatgacattttaatggcagacaagacaagaaagagaaatggtagaagtctgtgatgttcaaaggtgacatacatcacacccactcacattccattggctaaattatattacacataaagcccaaaagtcagtgtagtggtattgtaaactccaccttcaaggaggcacaacaactcacatggcaacaagcaaggacatataaatttctcatcactaagggagctagtatttgggaacaataatacaatcctccagaacaatgtacttctctcctttccccttctaatccccatgtgtgacaaaggaaaaccgaacatgtcatgttccctaggtaggaaagaggccaaggtaatggctaatatgagttgtggcctggttagtttcctctgggttctggtcaaatacttaatttgagccattatcttgcaaattgactgaggtctttaaagcataactagaacagagcaaatggatccatgtactaaaaaatacctagagacataaaaggaagacaataataatcaccaagaaatcaagtaaattgcacaaactaccccaaaaggggttaacataggtcttcttcctaagggcactaattaatttttataaaccaagcataaatagcactaatgaaacttaaagagaaagtggatttttaaggtatatcttgaaaggactcattttctgttctgttctcctgtggaagtttacataagtaaatgttataatcatttcctcaagatctaattaccagagattatgcattccagtgtttcttccttaattcaaaaatggttcagaaacccagtcatgaagataagaaaaaactaatagtaagtcctatgaatgcctatgactccctgagaacgcttaaaaaatgaaaaatgagttattcataagtgaacattattttaaatttttcagctagtatgaatcaatcattccaaaccaaattacactagaaatgtcctatccatattaaatcctaaattatgcacttaaatggctaactaataatttattctttgaaagaacatgaacaagactccaatcaattttcatgagacaggccaagcaaatatgaaactactgccaagtcccaagtgttccatcttagcaactttacaaaaaaaaaaaattgaatggaaaaccacaccatttttaaaataacttagctattaataaaatgaagtgtgtgtgagtgtgtgtgtgtgtgtgtgtgtgatctcatcaaacaatgcatgaatgtacttgagaaatggagttccaacagaccagggtcaccatgaggccttacggtaagtcttcttgctctgaacacttttgtgcagtacacaagcacacatctcttatgtaatggccctaaagtcttgggcaaactccatcttatccatcaaagagaaatataattattcaacacttatttcattcccaagtggacacttacctcagtggtcactaccttaaagagaaatctgagaagagccaaagtggcacttcaccttgctgtggcccaaggatgacttttgttgattatacaacccgctgctctcatttaattgagaaaccaggagggctgaggtgtgaaggaaatccccctaacatcctgaaaaaggtcacactacccatcacctaagctctgagtagaacacaaaacagtttctatttccagacaaggtaattgacttggctcttgatagtgatccctggagcaaaggtgttgctgaaagaaacacccaactattttgcttgtgaggaaaggagaagagtcctcctaaagaacagtttagacttagaatgtttaaattaaaggaccaataagagttattcaatcagaccctttcatatgacatataataaaagaaattcaaagcattttgatgactctcccaacatcacctagctatttttttttttctgagacagagtcttgctctgtcacccaggctagagtgcagtggtgtgatacctagctaatttttgactaaacttagatttgaacccacgtctcactactcagagatgattgttccttctgctacaattatgaaatcccggtttcagcaccaaattctcaaaaagggagaatagccaggatattagtgactaatattcaatgatggggcaaaaaaggaccccctagagtgacagaaatattatatatccgattgggattttggtcatacatgtgtatgtatttgcctgtatactcatcaaactgtatacttaagatctgtacatttcatcataaatcatatactattttgatattaaaattaaaatacataatgaagataatttgtgagatgccaagattcctagaaagatacaaccctcctagcctaaatcaggaaggattagataccctgaaaagaccaataacaagcagcgagattgaaatggtaatttaaaaattaccaacaaaaaaagtccaggaccagacagattcacagcagaattctaccagacattcaaagaagaattggtaccaatcctattgacattattccaccagatagagaaagagggaaccctccctaaatcattctatgaagccagtataactctaataccaaaaccaggaagggaaataaccaaaaaagaaaacacagactgatatccctgataagcatagatgctaaaatccttaacaaaatattagctaactgaatccaacaacatatcaaaaagataatccaccataatcaagtgggtttcataccagggatgcagggatggtttaacatatgcaagtcaataaatatgatacaccatataaacagaattaaaaacaaaaaacacatgatcatctcaatagatgcagaaaaagcactcaacaaaatccagcatcccttcatgattaaaactctcagcaaaatcaacatacaaggaacatacctcaatgtaataaaagccatctatgaaaaacccacagccaacataatagtgaatggggaaaagttgaaagcattccccctgagaactggaataagacaaggatgcccactctcaccactcctcttcaacagtactggaagtcctagccagagcaatcagacaagagaaagaaataaaggacatccaaatcagtaaagaagaagtcaaactgtcactgtttgctgacgatatgatcatttacctcaaaaaccctaaagactcctccagaaagctcctagaactgatgaaaagaattcagcaaagtctctggatgcaagattaacatacacaaatcttctatacaccaacagcaaccgagcagagaatcaaatcaagaactcaaccccttttacaatagctgcaaaataaaataaaataaaataaaataaaataaaataaaataaaataaaataaaataaaatacttaggaatgtacctaaccaaggaggtgaaagacctctacaacaaaaactacaaaacactgctgaaagaaatcagagatgacacaaacaaatggaaacacatcccatgctcatggatgggtaaaatcaatattgtgaaaatgaccacgctgccaagagcaatgcacaaattcaatgcaattcccatcaaaataccaccatcattcttcagagaattagaaaaaaaaaattctaaaattcatatggaaccaaaaaagagcccacatagccaaagcaagactaagcaaaaagaacaaatctggatgcatcatactacctgatttcaaactatactataaggccatagtcaccaaaacagcatggtactggtataaaaataggcacacagaccaatggaacagaatagagaacccagaaataaacccaaatacttacagccaactgatctttaacaaagcaaacaaaaacataaacataaatgggaaaggacacgcttttcagcaaatggtcctaggataatcggctagccacatgtaggagaatgaaactggatcctcatctcgcaccttaaacaaaaatcaactcaagatggatcaaagacttaaatctaagacctgaaaccataaagattgtgtaatagaagataaccccttctagatattggcttaggcaaagacttcatgaccaagaacccaaaagcaaatgcaacaaaagcaaagataaatagatgggacttaattaaactaaaatgcttctgcacagcaaaagaaataatcagcagagtgaacagacaacccacagagtgggagaaaatacctgcaaactatgcatctgacaaaggactaatatccagaatctacaaggaactcaaacaaatcagcaagaaaaaaaacaaacaaccccatcaaaaagtgggctaaggacatgaatagacaattctcaatagaaaatatacaaatggccaacaaacatatgaaaaagtgctcaacagcacaaatgatcagagaaatgcatatcaaaaccacgatgcaataccaccttactcctgcaagaatggccataattaaaaaatcaacaaataataggtgttggcatggatgtgatgaaaagggaacactttcacactgctggtgggaatgtaaactagtacaaacactatggaaaacatttgtgaagattctttaaagaactaaaagtagaactagcatttgatccagcaaacccactactggatatctacccagaggaaaagaagtcgttatatgaaaaagacatttgtacacaagtttatggcaacacaatttgtaattgcaaaaatatggaaccagcctaaatgcacatcaaccaaagagtggataaagaaaatgtggtatatgtatataccatggaatatgactcagccataaaaaggaatgaaataatggcattcacaacaacctggatggagttaaagaccattattctaagtgaagtaactcagcaatggaaaaccaaacgtcgtaggttctcatctgtaagtaggagcctaagctatgaagacacaaaggcataagaatgatataatggactttggggactcggcgggggaagggtgagagggggtgagggataaaagactacacattgggtacagtatacactgctcaggtgactgatgcaccaaaatctcagaaatcaccactaaagaacttttccatgcaaccaaacaccacccattctccaataactgttgagatttttttaaaagataattgcaaaagaataaaataaaataaaagcacccaagaggaatgcatggtagaacaggaagagatgaacataagggggatcataaaagccatagggactaaaagggaatctattgggtggtcagagcaaagacactggatgtggcagggaaaggaactctgaggttcctgaggaaactgaatatgctctcaaaagagcaacagctcaggatttcctccacaagacagggccccaaattcacattactaccttccccaccatgcaaggatgtgcccttctcccattatcctgtctccctgggcccgtgtctaaagagataagaaaaatcatgaggagaagatataagagaggaaaaaggaggtagactgggtctatgccacatgtacatatgcatagtacatttgtagaaatgcaaacctcattgaagtgccagtgtggaataggcagaaatcctcaacattcaggggtttagtttttagattactatacaagatgggcttctaactgctaggaagcaaccacaggatcttcgattacttaagagggaccagataactatgggcagataaggaaagaaaaaatgcctacaccagttttcataggtaagcagaagaataagaaactcacttatttccatctcatgaggacaagccacagaaattcattataatggatgagaacacagtacacatgggggaaagtaaagaaagtctgatacagtgaacaaattcccatctgaatatgctccaaaggaattgggcagtcaggcagtcatggtgagtacaacaggagagcactccaccctggactattagagcagctaaggcaggaaatgatgtgtcatgaagacatttcagtttggtgaaagcctaatattctactatgttaacatggccttcaaaaatatgaaggagaaaagttctctgaggaaacctactagtccaaatatccctacttgaaaggtggagagaatttcccactagaaatgattaaatattgaaaatatcttcaaaataagaaggctatgaaccagagagggctgaagggaaacacttatgtggcggggtctgcatgcaccccagcatctcatagaatgatgggatgaaaggatattgatttcctacacattatgcactcccatagttctccctgaatttatcagtttgctctccttttctctctcgtccccatttttcctttttctctacttttccccatgtctactgtgttctcattcattacactgaatgataatatacaaagaatgcagtggttatcaggatgaggaccatacctcaatcattcaggtagaatctactagaggtagcagagcaggcaaaatcctttaagagctggtatttggcttgttaaaaatatgtaatgtgcacaaggaaatgagcccataatacctactattaagggtgtagctagtgatgagtctgtgagtcaaccacatccctaaagtctgcattgaacatgatattgaaagttacatgtgcctcatgtaagagctacggcagaaactccaaagggtaaaataataaatgctcagtagaaccatattctaaagtaaggtataggctatcttgctaacaataaaccaaaaatggttctgctggcattgtcccatggcccagctcaaaaatataagatagttcagcgaagaatttttagtgagagttgtcaatgtggtagatatgttctcctgttcttcaccattatgagtctgggccatacccccctcactcccaaaagacataattaaactatttaaacgggaggtacacttctggggtatcatcacacttttttaatttttaatttttgtgagtacatagtaggtgtatatatttatggagtacatgagatactttgacacgggcatgcaatgcataatcacatcatggaaaatggggtattcatgctctcaagcattcattgtttgtgttacaaacaatccaattacactattttagttatttttaaatgtaaaattaaattattgttcactatagacacctgtcatgctatcaaatagtaggtcttatttattctttgtaactattttttgtatcaattaaccaaccctattccccctcctactacccttcccagcctctagtagccatccatctactctctatctccatgagttcaattgtttttatttttttagatcccacaaataagtgagaacctgtgaagcttgtctttctgtgcctgacttttttcacttaacataatgacctccagttccatccatgttgttgcaaatgacaacatctcattctttttacagctgaatagtactccattatgtatatgtaccacattttctttatccattcatctgttgatggacacttaggttgtttccaaatcttggctattatgaatagtgctgcaacaaacatgggagtgcagatatctctttgatatactgatttcctttctttggggtaaatactttgcagtgggattgctggatgatgtgatagctctgtttgaggaatctccaaactgttgtccatagtgtttttactaatttacattcccaccaagagcaaatgagggttctcttttcaccacattctctccagcatttcttattgcctgtcttttggataaaagtcattttaacaaggtgagatgatatttcattgtagttttgatgtgcatttctctggtgatcaatgatgttgaacaccttttcatatgcctgtttgccatggtatgtttgagaaatttctattcaaatctcttacagaattgccacatttaaacccaaactgactttctaaaccatgtattccattggttctaaaccatgtattccatgaattccactggagctgggcattggtcatctggttctctttttcagtttcttctttaagtatccaggccatccttcaatgactcctgctactgaaattttatggacagcataaacagttcagcaaacatcacaggtagctgaaaatgctgggtatagcttcatataaacacagtaatgttcagtcagactggatgcagtcaaggaatccaaacatgaaacaaagtctaagagtcctggcaggaaatttccacgtcttctgtgagaataagtttggcagtatcatactcagaaaaggtatacagccataaccaggggtacacttaaaaggaacctggggtatcatcaagtaattccggctatgggatctggggatcccaccatacttgactgtgcagttaacaagctgcacacatttccaggctccttggcgttgtgtattcaaattgctaggtcttgttttgggtccatatcccaaattgtggatggcactggtcctaaactgggcagacatgtctgatgagcttgttgattccactaattttcccccaaagggtctttatccatggccattcacatagtgcaagaacagaaagtgtgtgtctttggcattctgctgataatgcttatcccaaaagagtctaagaattaatcatctagtttttggccaccagccaccagtccacactgccaggacattggctgctgcccatgagtcagtaaaaaatgtaaaaaggagcattttcaggcttgttttccatggcaaacaccacaagccagaactccactcattgagcagaattgcctttccatgtacaattattgtaaattcctttttggggttacacagcagcactgaccacataacccactggcatttaaattagttgataagtctatgaatccggctcaggcatctgtaagaaacatggcatactgaagccatcaagatcaagaagaagtcccagtccatctaatgcagccatacatggagtgactggacacattttctgcaggtctaagacaccattcatgcccagtttgcttgccaccttggtataccgcttacacttaacaaggatgctcattgggcaagacctaatttatgagattttcctttgacccttcattgaaagggataccaggaggtcacaactgctacccttggtttgttactctactgatgtccaccagcaccagaaacaagccaatattagtccctgaaatgggatccaggcagtggtggtgtcagggaagcagcataagcaaaaactatgctgaggaaacagtggtactcaggcactacttcttgaaagggctatcctgtgccctaggatacaggactgtttgaaacgtctaaatgaataaacaaacatacacgacggtatgtttaagagtgcagtgagtgaagatgctttgaagcggacacatctcgaaaagtttgtattgaacagggtgttgcaagcaacacaacctctcaaggccatttgaggatttgttccccatggcaagcaccacagcccagaataacactcactaagcagaatgagtgcttcatgtggtccctctctagacacactgtaaacacatttttggagctgcacagctgcattggcccacatacccccaatggcctttaacataattgataagtcaatgaaacagacctaagcatacacaaaaaaaacttgaggtactgaagccaacaagtagcccaagtaaacatcccaaaccctacatctaaggcagccatagctgaagaaagactggatacattttctttagttctgagacaccaataatgcccagtttattctttccttactatatcacgtccatttaaacaaggacgctcataggcaagaatgaattcatgggattttcatttgacttttcattgaaagggatgccaggatggaacaacccctacccttggtttgttgctctattgacatccaccaacaccaggatcaagccaatattcatccctgaaataaggtataggcagtagcaagttcagagaagcaccatgaacaaaaccacaaaccattactggatgttatattaatgacatagcttaagggcgttaacagactataagcctgtttcataaacatttaaatttaaacatgaagggcgaatgggggaaaaaaaacctcagtggatgtcctttctttatttggatgattgttccttaatatttgacaggtttaatctttcagagcctattactcaaaattgtaccctctctctaaagaggacaatatgctgtccttggcacttccaatccaaataatgtcatctgtgtaatggtaccagaatacttccagtgaggtttcagtcttttctaagtctcagcctatccactggtgataaagtgtgggtctcattgccttgtcattttaacatataatgtaatccaaccatttaaggaaaatggactctaatcatattaattcatcaggatttgaaggaagcaatagcatatccactactgcatacaaggcccttcaggatgcacaatagactcctagtttgttatgacacctggaaaattattgagtaagaagacagctgccacattaaactagttataattcacactgaggtgtcaattgaccctgactattttcacaggccaactgtggctattgtaggatggtgtagcttctttaagcacatctgcttctatcagtccctcacctctttgctgacactgcagtgctggccttgggtaacctagtaagatataggttgtccactcatcctactaacactgttctaatggttacatttcccttgtgggtatatccattacaatcaatagaatatttccatgcacttaacaaaacttcccacaatacactcagcagtatcagttatatttatgtacctgtattggtcctctatactgggggctggctagcaagtgaactgctcccctactatcccacagaggtaaggttaatgttcttcatgtggacacatagaccctgagaaaggaaatgtttcaagctttttctttactctaaaaggggaagggcaaagtttaattctaccttgcttcaagcaaatgacaaagacctccaaaaagcttgttttaagtctcctgcagtttgtaaacacaaggattagtatctggttcacacaatgaactcagaaatctggcactgaagctgcgcctttcagaaggtacaataaaatacctggttttagagtgagctgcatttctaccacatgcaggttactgtgttttccaaagacattatgtgcttgctaccatgatgagtggtctgagattgtattaaaattaaaccattcaaggagtccctggcatgaaaagagggagcctcaaaaggaagatcacaaaattctagggcataggttacatttagcagccagtgaaagaaaaggcacattcctgaaatcatgtattgaatgagatgtccaacacacacaatatcaaataagtaatttggcagaggctatcttttggagagagggtctttacgaaataaccaaattaaaatgaagtcattatcatggtcctaatccaatatgactggtataagaagaggaaatttggacacagatacatctgcagggagaatgtcacatgaagacaaaggtggccatctacgagcaaagaagaaagtcctggaaaagaccctttcctcacatacctcagaagagacaatccatgcaaacaccttgatttctcactctgagcctccaaaactgtaagacaacaaatttcagttgcttaaccaccaagtctgtggtacttacctatggcaatcctagtgaacaattacaggatccaaaggcaaagacaaaaaaaaaagtcaaatatttccatattctaaagtgaggtgctaagccagcttgaaaagtaatggacccaaacgggatctgctgccattagcacatcacccactgttgggtgaagggtggagaagtacacaatgaagatgaccctccaagtacagcaagaaggctcctaaaaagacatacctgaaattagtcacatacatgggaggatctgcatgtaccctgacaactcagaaaaggatgagatgaagggatactgggttacatgcacagtataacccattggtattcctgaatttctcccagtcacactacttttatctcttcttttccctttgccttctactttccctcttttttcccaacccttccaagatcccattcatcatgctgagagatagctacctacaatgcagtgattctctaactgaagataggtacccaataattcaaagagacatttctatgggtagctggacaaggtaatcctaatggaatgcaattcaacatactcatcatccatatgtatggtttcctaaattagatgtatccaaaattaacatagagcagatctggaatgctctcccatcctttcacaatccatttgtcctatttcaaccatcaggatgtgatctctttttcccaaaaagcactgttacattaccaggctccagaaaaagaaggctaaaaatccaaggagtagatttgtcaaaatcatatggcaccctgacctccaagtctacacagcagcttggaatgcggtcaacatggacatggggcctccacagcttccaccagcacctcagggaactttgggcttttgcttcataccttgtctgcagctctgatgttgcaatccaaacggaagaaagagtacatatgtagggagctcatttttgctaaaatgaagggctatgcacactggatatagcaattgaatcagcacctgaagttggaaaaaggcaacagacaaaacctgccaaactttttaagggtccaatgacaatagaaaagaggcctccagagaatacctactaaatgttaattctcccgatttaagtagcaggatctgcaggcactccaccaattagaatgatggtatgatggaacacaggcttccctcactttttaaataagtaaactcaataaattaatccacccaattacctaataagaatgtagagagtagaccaggcacagtggctcacacctgtaatcccagcactttgggagaccaaggcaggcaaatcacctgaggtcaggagttcaagtccagcctggccaatgtggtgaaaccccgtctctaccaaaaatacaaaaactagccaggagtagcatacccactacaggtggatatgctagtgctgtagtcccagctactcgggaggctgacggaggagaatcacttgaacctgggaggtggaggttataatgagccaagatcatgccactgcacttcagcatgagcaacagagcaagactccgtctaaaaaaaaaaaagagtgtaaagcgtaaagatgttgtggatcagacacatccctgaaagccttccttaaacaggatactgaaagcaatgtatcttagaatataagagtttggccagagggtacaaaagacaaaataatacattcccagtaccccaaattttaaaccatggttctcagctatcttcacaaaaccttgaccaaaaatggttaagcagacattagcccatcacccacctctgggatataaaacatttgggtagaagaaggaagagggagattttggagggtgtggacaatgagatatgcatttctatcccatcctgactctgggcatcctcaacccctcctctgcctcataattaaacattctatttaaatgggaagtactggctggggaaatgccacatttagagcccaaatttgtcttcttagcctatgctccactgggaccttagtctggttcgtactcctattttattcagtctcttctctaagaatccaggcaatttctcaatagtccctgatgttggtaaaagatgtggcacatggttgcatccaccagaagtcccatgaagcctctcactactgggtaacttttcctctgaaagtgccaccattgtctcattgaatgtggttgctgaatacaaatataagacacagtccaaataagagttctggtatgttgcttccccttgctatggaaatgaggatgtcagtgccattttttataaaggtacctactgcatccttggccagcagtatccttgaaagaaggttagggtaccaagtctggtatttctgcctatctgaaaaggagattccccctccactgggttgtatagccagcatcttaggcgcattctccaggtttccttggcctcatgggatggaatcagtaggtgttgttttggtgccagatcctgaattgaagttggattttcatgctttgttgcatactttatccagattgtttggtactaacctggccaaaacatgtctgatcagcttgttgattccattgaatttcattctcaaaagctccttatccatgcacatcacatggtgaatgagtaggagttgtgtgtcttatgatattggttgataatattttctaagcctgagtcttgatcaggcttcctgcatccaagcaacagtccacattttcaccaaatggacacatgcttgggaattaatcgaaaggtaagaaggtgcattttgggaagcgatttccagggcaagcaccacagcctgtaactccaactactgagtagaatgtcccttttcacacgtagatgcaagcagttttcttgggggttgtacagcttctacacctcacaaatccttcggtcttaaacttagctgataagtccataaatcacatccaggcatcctggggactctgagtgtaccaaagccaccaagaaggccaagatgctgggcacagttcctgtacctgagacagccacatctagaaagcaactggatgctttttcttatacctctgagaaaccattaacgcatggtttatgcattcctttgatataccactttcacttataaatggatattccttgggtaatatctactttgttggtgttcacatatggcactcttctgtgatagaaaactcaagccatattacacctgatcttgcttcattacttgcccaatgtacaataacacccactaataaatctctcaaatggggcacataaggtggtggtttcagtcatacattaagaacaaaacccaaaaggttctactttctaatggccacatctttttgctgcaggctccagtctgtatcaatatcattcactgacaactttctcaaaaatactgcacagagaatgatctgagtagaaaggtggacttacactgctgcccagagagtttctaaaataggttgatggtcaaattacatgtacttaaagataagttgtgcaatggtctgagcaagatcccaaagtgaggtataaagtaaaacaatactgaaaaagtttattataagtggtgcaaaatatgatttcctggaggcttttagactatcagtttttcttgaacaaattcatggattgtttttggacatcaaccaacatggtttccaaaaactatacttcagtggctggcccccaattcttatagagttaatcttcaagttctggttactcagatatcaatctacctacctaagacagacagtatgtattccttagtctacctaatttgaataatgtcatccatgtaatgttaccaagacagcttggctgctctttcaatcttctgtatttctgggcctatgtaatgttgaaaaaaacaagggaggtgttaggtcatcttgaggcagcacattgaacatgtgttgtaatctgagccccatgaagtcaaataggctccaatcccacggatgcagtgggattgaaagaaagcattatcatgtccaccaccaagaacaagaccccatggtctgtgcaatggatcccatgatcattaacccttgaaatgcaggtacaaggactactctgcattcagcttgctgtatgacacagtgaggcatcaaatactcattgtattttatcaccaactatactgggctaatacagggtagtatactttccttaagcacctctctctccattagttccttaatcagtgtatggaccttctttcatcctctgccctcaacctggtatcttacatggcttgactgatatatcacagcttgtaccgtggaagcctagtgggatcttggttgtcaactcgtcccactaccatatcctaattgtggcatttccccattgggaacatcccttaccatcacaagaagaattactgactctcagactgaaggatgtttactctcagactaaatgagtgtttaagagaatcctttctggccaatacactctgcagtctcgcctacaacactttggatgtgtattggccagaaaggactcacctcaaaactcattttaaatacattcttcagcctgagagtcagtgtaaatcttcataagaacatcaggggtcactacacagcacagcgatttgttccccagtgtccaaaattgcagaaaagattgttcaacctgggaacagtcaattcccccatacactcaaatcagtacataaagcctccatttgctattataactgaaaggtccttgacatctatcctagactcttttttacttctaagaagtaaggtctaagtagaaaggtggagtgcttgatgttagataaccttatgaatagcatcaaactcagcaaagttttctaggtcttcttggtcctcctttgtcattagtgagaatgtcatagccagactaacttaaaaaatgagagctcagtcacagacgactgggtgatctccattccttcttctccagcacgatgtggagggttccctcatctactagacaaggagtcaagtatatacaggctcaatgggtgcttgtccaaaattcttcaatattacttctcagccaagcatgatggctcatgcctgtaaatccaacactttgggaggctgaggcaggaggatggcttaagccaaggagttcaagacctaggcaatatggtgagactgcgtctctacaaaaaaaaaaaaaagtttagaaattagcaggacatggtggcgtgcgcctgtggtcccagctactcaggaggctgaggcgggaagatcacttgatcccaggagatcgaggctgcagtgagccatgatcctgctactgcactccagcctgggtgacagggtgagactcggtctcaaaaaaataataataataacttatttcccactaaatgtaggaatagacttcacatttttaaataaccaactgcccctttacaacagacactttttcaaaaaggtctaccactgccttgcagataccgtaccatacttagacagtcaacctgcagattctcacctaattccctaaaaagggcactgtggccttaccagcctccaagaaaaggggttaaaatcacatgtagtaagttcctcaaaaagaggttggtcaaaggcctgtgtggtattgcctcttttactacaggataaatgagccagtcagtatttacaacagttttgtaggagcaacaagttttctctcagaacgtagaattcttggacatttttttctaataggacacaatccatttgtcctatttcaaccatcaggatctgatctgagccaagattgcgccactgcactctagcctgggcgacagagcagagactccatctcccaaaaaaaaaaaaaaaaaaaaaaagatgtctaagaaaaaaaaaaaagacagcagtactgagtgtgtgaactcacttaagttattttgagtacaataactggcaggcgggccctgattttgctagggatctaaattctcctttgccgggggcacccaaggacataaagaatgccaccttcaacttgccaatcaacaaaacatcattgtagagtaaaaactttggaaatcaggaatttttttctcatacaaaataaacattcaaaactcaaaaacatgacaaattacagagacaaagatattgaatgcaatatgtcccctcatgtaagagatatggcagatactccaaaggataaaacattaaatgcccaggactcaatattttaaagtgaagtgctgcacaatcttgccaagaaatagaccataactggttccacgtattgtcacatgacccagccctaagatattaaataatttagttattaaatagaagaaatacagcattttgtgagagttgtcaatgtaagagacactcttcaccatcatgagtttgggccaagtatccccactccttaactaaataattaggctgggtgcggtggctcacgcctgtaatcccagcacttcaggaggctgaggcaggtgaatcacttgaggtcaggagttcgagaccagcctggccaacatggtgaaaccctatctctactaaaaatacaaaaattagctgggcatggtggcacatgcctgttgtcccaactactcgggaggctgagatgagaggatcacttgaacccaggaggcggaggctgcagtgagccgagatcatgacagtgcactctagcctgggcgacagagcaagactccaccacaaaaataattaattaattaaacattctatttaaatgggaggtacccttctgaggaattatcacatttagtacccatactgactttcttaaacatgtgctccactgggagctgaaaataagtcatctagttctcatttttaggctattccttaagaatccatgccattctccaacacaacatgctacctggctattattcagagtgtgaagcaaacaagccaggcagctgcccactaatgggtacttcctataaacctggcatcattatctgattatatgcagtcaatgaatccagccatgtagaaaaatctaagagtacctgcatagaattatcctgtctgctgtggaaatgggttggctgtgtgacactaaaaacagtaatctaatgcaatccacgatcatcagtacccttgaaaagagggtacgggggtcagttctggtacttctggctatgggacctggagatcctctctctacttgactgtgcagcaggcacactctgtaccttttctagaattctttggcctcgtgtgttggaaacactagatcatattttgaggccaggtctcaaattgtagatacattatcatgtcttgttgcatagtcaatccacattaccatggtcctaacctgggcaggacatgtctgatgagcttcttggttcctctgattttgatactaaaacaatccttattcatggttatccacataaagcacgaaaaggaaatatgtgtcttgggaattctgctgctaagattcatccccacgagattccctgaagagctaaaggtagatctaccattcaatccagcaatctcactactgggtatctacccaaaagaaaataagtcattatattaaaaagacacttgcacgcatatatttatagcggtaaaattcacaattgcaaagatgtggaaccaccctacatacctgtcaacaaatgagtggataaagaaaatgtggtacatatacaccatggaatactactcatccattaaaaggaatgaaataatgtcctttccagcaacttggatggagctggaggccattattctctaagtaacacaggagtggaaaaccaaaaaccatatgttcttacttataagtgggagctaagctactagtatgcaaaggcatacagaatgagatcgcggacttcagagactcagaagaggggagggtaagaaggggctagggattgaaaaaactacacattaggtacaatgtacactacttgggtgaggggtgcactaaaatctcataattcaccactatataattcattaatataacaaaaaatcacttgtaccctaaaagctattgaaaaaaaaatttttttaagattcatccccacagagactatgtgtcatctagtccttcatccatcagccaccagcccacgctgccaggctattggcagctactccagagtcactcaaaatgtaacaatgtatatttgggaacttgatctccagggcaatcaacacagcccagatcttcactctgaaaattttcatttccatgtaattgttaacagtttgggggacgttgcacagatgcactggcccacatacctcttttcctttatcttagatgataagtccctgaacaagatgtagatatccaccagaaatttgttgtattaaggccaccaagaagtccaaggtgtcacagttgctgcaactatgacagccttttctggagagtaactgaacacactgtcctatagctctgagatatcattaatgcctggtatctgtctttcttagatatatatgttacagttaaaaatggatgctacactgggcgtggtggctcatgcctgtaatcctagcactttgggaggccgaggcaggcagattgctcgagctcaggagtttcagaccagcctgggcaacatggtgaaaccctgtctctactaaaatacaaaaaattagccaggcttggtggcatgcacctgtagtcccacctacttgtgaggctgaggcaggagaattgcttgaacccgggaggcggaggttgcagtgagcagagatcgcgccactgcactccagcctaggcagcagagcaagactccaatttcaaaaaaaacaaaaaaaaagaggatgttacttgggcaagacccactttattggtattttcatttaggacaaatcccatggtatggaaatcagggcataacaccatctgtcttgctttgttactttctcagtgtccactggcaaccaataacaagccaacaataatctctcaaatggagtatatcaggtagcaatgtcaagcaagcactatgagcaaatcccaaatggtgaagacatcgtattgccactgggtcctgcaaaaatgttagtcactgacactttctctcaaaacataatgcaagggtaccaggctgagagaaaatctggtctgtacagcttgttgaagaggttgtaagtcatgttgttgtccaaagtgtaagcgtttcaagtaatcttaggtaatgtgctaagcaggacccccagagtagatatgaaatgcatcccatactgaatgaagttatcatattttatgtttcatgtgggttgctatagatttgaggccataagtttttctttaaaaagttccaggattgttctttgggcatcagccacattctttccattagtggctggctgctaatatgagtctgggttaatcttccagccctggtctcttggttttcagaccatctttctcaggtatatggtatgctgcccatagcctgccaatctgaataatgtcatcgtgtaaggttaccaggacccctctggtgaggtttcagtcttattttggtcatggaatacccactgatgaaaaattgcttgaaagtataggtcaatgtggagcggcacagtggacatatattgtcatatgagctttatgagtcaaatatgctttgatcatatggttgcagtggtatctgaagaaagcttcacattaatatgtctaccacaggattccaggttcttcatgctgtgcaatagactccacaactattatgatgtctggaaaagcagggcaagtattaggaaaactgctgttatattgatcttatgagtcaacacagtgaggtgtcaagaaccattggattcacgcctgtaatcccagcactttggggagccaaggtgggtggatcacctgaggtcaggagttcgagaccagcctggccaacatggtgaaacccagtctctactaaaaatacaaaaaaaaattagccgggcatggtggctcgtgcctgtaatcccagctacttgggaggctgagacacgagaatcgcttgaacccgggaggcagaggttgcaatgagccgagattgtgccactgcactccagcctaggtgacagagtgagaatctgtctcaaaaaaaaaaaaaaaaaaaaaccattggattatttcactggtaaaatagggctgttgtagaataccatagtcttgtgaaacatctctgcttccattacttccttggtcagtgtagagtcctcctttcaccaccaaaccccaaatcacagcatcctaccacacttggttgttacctcatggctggtctgaggaagcctggtgggctctgatcgctcacttatcccactgccactgttctatattggcatttccctattggaaacatcccttacaatcaagaaaataattacaaatcttaacacaactcttaccacaatacacttaccagtaccagtttataacacctttcatatgtattgacatgaaacggctcaactataaacatacataagtccattatccaatatgaggactattttcaatcaagtcaaagtaaaattttgattgtgctttggatgcatcaaagcagctgatatggtttggctgtgtccccactcaaatctcatcttgaattgtagctcccgcaattcccacgtattgtgggagggacctggtgggaggtaattgaatgatggaggcaggtatttcctgtgctgttcttgtgatagtgaataagtctcacgagatctgatggtttgataaaggggagtctccctgcacaggtcctcttctcgtcagctgccatgtgagacgtgccttttgccttctgccatgattgtgaggcctccccagccacgtggaactgtgaacccattaaacctttttttccttataaattacccagtctgaggtacgtctttatcaggagcgtgaaaatggactaatacactaaattggtgtactggtgtagagtggggcactgctgaaaaaacacccaaaaatgtggaagcaactttggaactgggtaacagacagaggttggaacagtttggagggctcagaagaagacaggaaaatgtgggaaagtttggaacttcctagagacttgttgaatggctttgaccaaaatgctgataatgatatggacaatgaaatccaggctgaagtggtctcaggtggacatgagaaacttgttgagaactggagcaaaagcgactcttgttatgttttagcaaagagactggtggcattttgcccctgccctagggatttgtggaactttgaacttgagagagacgatttagggtatctggtggaagaaatttctaagcagcaaagcattcaagaggtgacttgggtgctgttaaaagcattcagttttaaaagggaaacagagcaaaagcaggagcaagagggagacagcaagatgccatactcttttaaaccaccagatctcatgagagatctgcggcaaggacagcaccaaggggatggtgctaagccattcatgagaaatccacccccatgatccagtcacctctcaccaggtcccacatccaacactggggattacaattcaacatgagatttaggcagggacacacttccaaactatattaactagctatgctggcagggtcaaactgctcccaggcctccaggcagggtactcaagcagggcagcaggggctatgctgtggtcaccctcctgcaggagcatccacgcaggcagtcttgggaggggccggcaagcaaaggggcatatgaatcaggtgtgccccaattccgcagcagtagtggccctgctctctgccagcccggcagacagcaggaacagcagccactgactgcaaaatggaaagccttggaggataggcagctatggtcatgctttcccgcagctgcaccactcagcaaccttctgtgctctgtacaggttcaagttctgccactgtctgatctctgggtggctccccttgccagttcaaatctctatgcaggtcgtaaaaactcctatggttgggatcccagaagttagccgtgggagtctgtgccctggagttccttcactcacactttccttaggtctcattcatggccagggacctgtcctcatgcccagtgtctccaggcaggcttcccagcttcctccctcttcaactatggtgtctgtgtcacctctctatcgattttcagtgatttctctcaaaagatctgttcaaagtgtgatggtttacttgaaattgtggtttctcttggtggaagaggcattttccagccacatccagtaagccatcttgcccctctcccactctgctgaaagcctatcttgaactggatgtttaatgcaatatgttttcaggtgtgccaaacaaagagatttagcaaaggcactaaatgccaaaataagaaacgtataggataataaactactaatcaacaaaaacctgatcaaagctgagtcagcagacatctaattccttttgaactcatgagtatgaaaagttgaggtagaaaaagaggaaagaaactttggaaacagttatcattgtagtaggcattttcttcctcagactgaatctaggcctctgctcttctcctcctcctctccccaacaaaattattaaacattcctgctggggaaatgccacatgtagacccaaactgactttcttaagtgtgtgctccactgagagttgagcatcagtcatacatttctatttaaatttttttctttaagaattctaagccgggcgcagtggctcacgcctgtaatcccagcactttgggaggctgaggcaggtggatcatgaggtcaggagatcgagatcatcctggctaacacggtgaaaccccgtctctactaaaaaatacaaaaaattagccgggcgtcgtggcgggagcctgtagtcccagctactcgggaggctgaggcaggagaatggcgtgaacccaggaggcagaggttgcagtgagcagagattgcgccactgaactccagcctgggcgacagagcaagactccgtctcaaaaaaaaaaaaaaagaattctagccattcttcccagttacttaggaggctgaggtgggaggatggcttgagtctgggaggttgaggctgcggtgagccatgatcatgccactgcactccaggctgggcaacagagactctgtcttaaaaaaaaaacaaaacactaacctcaacattatacaatatacccatgtaacaaacctgcacatgtaccccctgaaacagaataatttcttaaaactctggcccaaacttcatcactatgcaatatatgcatgtaagaaacctgcacttgtgcccactaaatatataaaaataagtaaaattattttaaatatctgactgaaaaaacttacatacaattcttccatctgctgggcagaaggttggcagtggcatactcagataagaaatcaactgtagtccatacccagcccagcaaccttgaatagagggaatgggatagattgaacacctctgcatttggaaggtggagatccccactctactcgaccatgtagctgatggtcttgacacatttccaggcttccttggcctcatgtgctggaaacactaggtcttgtgcttgggccaggtcctgaattatagatgaatcacaatgacttgttgcagagtctatccaggttgctacggtgctgagttgggcaggacatgccttatcagcttattgattcctagaattttaatctgaaagggtcctaatccatacatagtcacatgggccatgaacaggtatgcatcttctgaaatcgactaataatatctaccacctcggaggctgagactggataaactagtcatcacaccaccagaccctccaggagtccatctaaatgttttttgttttttgcttttttattattatactttaagttctagggtacatgtgcacaacgtgcaggtttgttacatatgtatacatgtgccatgcacgtgtgctgtacccattaactcctcatttacattaggcatatcccctaatgctatcgctcccccctccccccactccactacaggccccggtgtgtgatgttccccttcctgtgtccaagtgttctcattgttcagttcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccatattttcttaatccagtctatcattgttggacatttgggttggttccaagtctttgctattgtgaatagtggagtccatctaaatgttaaaagatgtatttaagggatattttcaaggtaaaatgcacagcccatacctccatcccaatcattaagcagaactcccttttccatgcataggtacaagcagttttctttggtgttgtataccttccacagctactataactagtctgtctttagctcagcagatgtatccatgtactaaacccaggtatcctgaggaacctgggtgtcccaaaccagcagaagacagagtgctgtcatggtccctgcatgtcagtcaactgcatgtggagagtgactggacattttttccagcacctctaagacaccattaatgcccagtttacttcttcaagttacatatcacttccacttaaaaatggatattatggctgggaatggtggctcacatctataatctcaacactttgagaggctgaggcaggagaattgcttgagcccaggagttggaggctaacctgggcaacatggtgagaccctatctctacaaaaaaatttaaaaattagctgggcatggtggtgcatgtctgtagtcccaactactcaggaggctgaggtgaaaggattgcttgagcctgggaggtcaaggctgcagtgagccctgatcatgccactgcacttcaacctgggacacagagcaagaccctgtctcaaaaaaatggatattacttgggcaatacctacattatctgagttctcatttgagacctgtcccatgatagggaagttaggccattacaacccttgctcttgcttgtgactttttctatgtccaccagcacctgataacaggcagcaatcgtctatcaaatggcataccttgagtggtgatgtcaggcaaaggtcatgaaaaaagagtgccactgccttgtggactacagctttgccagtcattatattctgaataactgtcgattactgacacattgtgtcaaaatggtgggcactgatgactggcccaagtggaaaggtggtctgtgcagcttgttgcacagtttctaaggcatgttgttggtcaaagtggtgcctttccaataatcttacgtaatgggatgaacggggtcctcttgagataagaaattcatgtgatactggtcaaatatatcatatgctatgccacacttggttttcagaaggtttaaggccatcagtttttcttgaacaggctctgggattgttatctgggcagcagcctacatgattcaccagaactatatctgggtggcaggccactgattcttgtcagaattaaactttcggtgctggttattcaaatttcagccgtatatctaagacagaaaatatgctgtctttactgcttccaatcagaatacagtcatatttactggtaccaggactctggtgagaactcagtcttttgcaggtcttgaccaatccacttgtgagaaatcgtgtaaagggttaagtgtctatgtggcagaatagagcttattttgcatgctaagcccccataaaggctctgatcccctgattatagtgggatatgaagaaaacattaatatatccagcattacataccaggcccttcaatctgtacaatggagtctgtgaccactatgatatctaaaacagcaggggtaaggaggacaggctgccacaaaaagcttgcagttatccacagtaaggggtcaagcagcactggtttttctcactgatcacaggaggctattgtagtatgctactgtctctttaagcaactctgcatctataagttccttgataagtgtagggatctcttatcacttggtccctaacatagaatcctacactgctttattggtcattattggcttagtggagatgtctgtggggcttaaggtttttcatttgtatcactaccactgttctaatcatagcatttccccatcggaaacatcccttacaatcaagagaagaattacacacacttaacatagttattccccataatactcagatatgtcatttacaacaacttgcatgtgtattggaccatagaggcagagccataaactcctatcagttcatagtccaatctgagagatatttcaacattcagagtacatttttgaccatgcgtgtggatacttccactcagcagagtgacttctgcctcacgtccataatgaccgaaaaagtttaaaacatgtctactgtcaagtccccccagtatcctttgaccagtgggtaaagccttctggtccagttagagaaggttcagggtcttaaactctaccttagaacttcttttaagagcaagaaacggtggtgttgaatgtgttagataaacagtcagaagaaaacagatctcagaaagattttctaggtgttcgagttcctcctctaaacattacccaggtgcttatgggctgagtggctggaataccggaatggtcaataggccattgggtaattttaactccttcccctccagcacaactgatagagctcccacatttgcttgtcaaggaggaatcctatagttcattaaagttttgaccaaacttatccttaatgtccctccacttctgctcattggaaaaacaggcctcaatacatttctgtaaatgaccaccactgatcagcagggaggaattcatttatggtcagggctagtagccagaggaaaggagttttagtttctcagtgacacagatgggtgcccaataactacgtaatgcttttattagatttatgtggtcctacccaatttatgtctagctcaaaccacctttgcaactcggcagggaactcaggaaaatggtgaaagatcacttggccccatgtcaccaaagatttgggcagcatggtcttacaatgtgccagagctgtgaacactaacatgttttctattctgtagctctcttctggaggtaaatggacaggaaaaagccttatatctcaaaagaccacagaggggaagagaaactgccccataacaacctttcataagagataaagaggcaagtgggagacagcatttggagcaattcttcacatgcctcccattgtcctgcattttagagggatcacaaagtgttctgtcgcactcagaagagctttgctgaagcttatccctctgtggcttatatggatatgttcaaggtcaccagggcaaaaatgcagagcaatgccctacatgtggttaacaccaggacattcctcctcctcagacactcataagtcgcataatcatccacggaagaagctgacactgtccattacctaccacctgtttctctgtactcagttgcacgactggagacccacgatggattatgaaatgagtgataggatggctgacacaagagcaacagattccaagagctgcactcatgatcctgacttattggaacacagataccaattgattcatataggaaaagaatctggggcaggagttgctccttttacaagagaagaagtgggcttccttgcgagttaactacaattaattctgcctcctgtcgaagaaacacttgtgctctccatgtagataatgtggaccctgagaaaggtattatggtgggcttttttctaccctgaagaggaagggacaaattttacttccccttttacttcaagcaaatgacaaggaacttaagaaagcttgctttatatccccctggaactcataaaaacacaggggtaatgtctaactctcacaagtgaagtcaaagtcttgggctggatgggcccctgccagaaagtacaataagaaggttagcttgggagtgaactacaaatgtaccacatacagaataaagcctgtgctttccaatatccacatataggcactgtgagggtgagtggcctgagactgtattaaatgaaagcaccacaaagagcccttagaaagaaaggagggggcacagcagagagatggctcacaaaattcaagaaggtagaacatttctagtgggcagtcaagggaaggcctgatcctgcaagcctgtagtgaacaggatattgaataccttctcagggaacagacttgtcagaggctacaaacaccagaacaataaatgacaaatactcccatattctaaagtaagacgctaaggattcgctaattacccagatttaatcattacatgatgtatatatgtatcaaaacatcacattgtgccccataaatgtatacaattgttgtgtcaattaaaactaaaatactttttaagtggaatcaaatggatattattagaccaccatccaccacagagatacgaaataattgatgctgggcacagtggctcatgcttataatcctaacactttgggaagccaaggcagaaggattgcttgagcccaggagctcacgaccagcctgggcaacatagcaagaccctatctctaaaaaaaatttttttttaattagctgggtgtggtggcacacacctgtagccctacctactcaggaggctgaggcaggagaatcacttgagcccgagaatttgaggtttcagtgagctataatcatgccattgcaccccagcctgggcaacagagcaagactctgtctcaaaaaaataaataaataaaagaattgacatggaagaagcaaaaataatttagggagaaagttgtcagtgtattcagcattttatccccagggatagggactgtttcttcctcactacaaatcactcactgactacaaatcaagagcttcagaaaacttgactgatgccctggtaggctggttgagaaacatagaactaatgtctgactcacgtcagtaaaattaacatgctggggcttgaagtacccctaaagaagggagagtaacagtgtatctttgattgaaaagcaaattcaacctttacagaagcaagatctttgatttccagggttgatatatggaccttgggaaaaagagtggcctgagagtaacttaaaagatatgtcaatcaaaaaaacctgctggagaagcaaatgaccccagaagaggtgaaggccataaaaggcctcaaaactgagtgagaacctagtgatcagtcagataaaaggcactcgatgtgacaggaacatgaagtctgaggtccctatagaaaaatgaaaatgtccccacgagaggctctgctcagtatttcctccatatctcaaagcccaatgcccacaaaacaacttaaccagctatgcaagaatgtgctcttctggagtcttcctctttctgagtttggcatcaatgaaaatgaacagtggcacagttggagagaacatggaaaaaaggcaaaacctgagtgcctatttccacccaacacccatgcacaaatatcacatgcagaattccaatctttaagcaggcctcaggagggagtggaagataattcccaatattcaaaaattaggactttgattatacactgtaatcagcttcataaagattgcaaatggctacaggacatttggcttcataagaggaaacaaagtctatgggacctacctggactttcatcacagacatgggaacaacagatccaagccagtttgcacagtgaaaaagaaaatgaatagtttctcttggaactcatcaaaaggaatttgaattaagaaacagtggtgaatttctaatgtgaatatgctacaaatttatttgacaaactggaattcatagtgagtgctgcaggagagcaaccatcatatgcactacctgatatcacaaggcaggaaatagcggcacattttgacttctcagctatccacaaatatgttttactaataacgtaaggggccttcaaaatggcaaaagaaaagacctgaaagccgggcgtggtggctcacacctgtaatcccagcactttgggaggccgaggtgggcagatcacttgaggtcaggagttcaagatcagcctggccaacatggtaaaaccctatctccactaaaaatacaaaaaccagccaggcgtggtggcacgtgcctgtagtcccagctactcgggaggctgaggcacaagaatcgcttgaacctgggggcagaggtggcagtgagccatgatcatgccactgcactcttgcctggatgacagagcgagactccgtctcagaaaaaaaaaaaaaaaagacaagacaaggcctggaacatgaacatgtcacattacagtaggaagacagagtaaaaatgcagaatctggtgttatccaaaatgaaggtttacccattgattggactaggtgcctgaagctgcagtgaaatcaataaccaacaaataccaagttttttaaggaaccttgaaatatacaaaacaggctctatgagaaaacccacaagactaaatactcaggcttgaaagtacagggacaattggctttccctcactttatcctaccatgacctcctggtagtctcctacatctcctttcatcctttctcttccagattctcttattactcaacctttctgctattctcaatcaatcttctgatgaatgtaagaaaacaatgcagtggttctctggctccaatcaggactcctatcctacagggaaatttcttggagaaacttgagcacagagagtcttaatggaatcaatttccccattctcatcttttaattgtatgttttcctaaagaacatcaatgtatgaaggattctggaactaaggcaggccttcctccatcccctttcacaaagtctgtcaatttacaaaaacaaggagaaaatctcactaactcccattttgaaagggtgcactgcccagaatgtagacatctgggagctccaaatgatctggactccaggtatcaaaagaactcacatcagatggcagagtaggagaccctaggcatcaatctgtccaccagaacaactactgagctggcaaaatctgtctggagcattaaatttatagctctgcaaactagttgaacacttacagcatcaggggagcatgtgatgaagaaaaaggctgaaaaatgtcagtgaaattttaagcccccagaagctagaggggctaaatcactgaggaagagaagttagacttagagctgcccctgtcagaggcacaataagaggactggtttaggagagaactacactttcactatatgcaggaaaaaggaatatattctccgtgggagatacgtggaacctaagaaaaagagttgctggttattttctcctcactcatgagggagggacaaagatcagttgattcttgcttcaagcaaataacagaggttcaaaaagcttctcttatgtcccctgaaacacattaaccagtgtctcattcttccaagtgatgacaagaatctggggatggagcaaccctaaaaaaaggcacaacaaggatgacttggaaaatgaactgcagctccaacatgatggtggggccatagtagaaatatgctgccaccacaacacatgtaaacttgagctcctgccaagcctagaactcatcactgtgtgcctgaagctctggcatattacaatacaaccaaaatattgagtagaaatgtgagggggaaaagtgtttgcaaaagaaagggttacacactggctggcccagaatgaacagatggctgaatccagtagacataaagacttttcaagaggtctttaaatatgtatgtgcctggagccccagcataaattgtcaaaaaaaaatatgagaactgacctccccacacatatggttgctcaggaccaggttcacttggagatgaggcccctaaaactgctatcaccaacacaaagtggcaatctcacttcctactttagtgtgtagaactccaatatgtagtaatccaaatgccagaaagaatacaaatgccgagaactaggttttgctaaattaaatgctacacacactgatcaccagaatcaaattcatacctgaagctggagtaaacaaataccaagtttttttaaggggactttgaaaaacaaagaaggctctcagaaaacatccactagccgagatatctatgcttgaaagtttggcagataattttgcactggatataatccaacataaaaattctgggatcaacagaggcactaagtacagaaagagctgaaggaagtcaaatatatggcaggatttgcatgcatgctaacaacacaaagaatgaggggtgatgctgactcaccctcacatttgatgtaagtaaagtgaataagctaatggacctgagtatctaagataagggtgaaaatacatatgtacaactattatgtatccataaaaattacaaattaaaaaacacccttgccagaggctccaaagaacagaacaataaatgtcaagtactctgtattctaaaacaaggttctgagacatctcaccaaaaacttgacctaaactgattctactagattagcccatcacatacctctgtaatataaaaagttgtgttgaaagagaaggaaaagaattttgaaaggagttgtctctgtggtagacattttcttctccatcctgactctgggcctcctctatcctctcctcaacttcttgctttgttattctctcaatgtcactaactagaagtcatttctcaatggtggtatatcaggtggcagttttaggcaaggaccacatacgaatcccaaagtggccacaacattttaccacagttcctgtgagcattaatattcattgctaaaactttctttcaaaacgtgactgactggcctgagtgaaacaatggtctgtacagcttgacagataatatcaaaggcaggttgttggtcaactcaaatgacttttgagtaatcttatataatgagctgagcaggatccccacatgaggtataaagtcaactcaatacgctcaagcttatcatgtgctctctcaaatttgtttttctggtgtttttaaggccatcagtttttcttgagcagactcaaggagtatactctgggcatcaattcacatgtttcatcagaactttatctgggttctggctactgggtcttgtcagggttattaatcttccagtgctggttactcagatattggaccatctatctaccacagacaatatgctgtccttagtgcttccaatcagaatgatgccagtcatataatgggaccaggacacctctggtgagaattcagtctttcctaggactcggcctatccaccagtgagaaatcatgggaaagtttaggtcacactggggcagcaaggtgaatacatgttgtaatcagatccccaagaagctaattagactttcaacacacaatgggatctgaaaaaaacattggtatgtccactattgcagaccaagccattcattctgcacatgaccatgaacattacaatatctggaagtaaaggaacaaggaggactactgctacattgagctcatggcaaaaagacagtgaggtttcagttactatattggttttttgattagttaagggtccttctttcacatgtcccacctcccaccccaactcagtatctgatatggtttggctgtgtccccacccaaatctcaacttgaattgtagctcccagaattcccacatgttgtgggagggacccaggtgaagtaattgaatcatgggggctggtctttcccgtgctattctcatgatagtggataagtctcacgagatctgatgggtttatcaagggtttccgcttttgctgcttcttcatttttctcttgctgccgccatataagaggtgccttttgcctcccgccatgattctgaggcctcctcagccatgtggaactgtaagtccaattaaaacttttttttctttccagtctcaggtgtgtctttatcagcagtgggaaaatggactaatacagtatcttaaactgctttaacaatgcctctaggctgggaatcctggtgggttcccagttgtattaatgccccactaccactattctattgtggcatttccccattgagaacatctcttacaaacaaggacatcccttacaaacaagaaaatatttaacacaactcttcccacagcacattcagcagtatcaattacaacaacttgcctgtctatttgaccaggggagcccacccataaactctcattagtccatagtccaatctgagaggcatgtacacatccaacgtaaatttcatttttgcttacaaaaaagtattagaactggcaaatatgccctaaatcttgctggggatcacaagtctcccttgctggagggcatcaaaggccatagagaatgaatgacaccttcaacttaccaattaacaaaacaccattataaagtgaaagaactgaacatcagaggaatttttctctgaaaccatatgaacattcacaattcaaacacgtaccacatttcaacaccaattacacattattatatactgtatacaatgagttggcttgcaggtctccaaatgacaaaatcacttttaattatttatcttttcaccacaagttatacagttgcattcagacactttttacaggaacacagaccatggatatttttataacgtgagtttccaggagactccttgggtggaagtttctactctcctgggatggaagcttgaaaaataaaagggggagcatacaggcagagcaactggcacagtaagcaaagattttcacatactttcaaccattctaaggccacaaaaaatgtgcttataacaacaattaggcacaaatcagacaggtgattccaatcccacctattgctgcctaacccccaaaactttcttcaaaacgtagcatacattatcagataccagagaatctgtcttacccctaacctggtccacacaccctggaagactaaacagtggaaggactctcatgtccttgtagacaagggtgggctaccagaccctagggagccatacctctcataatctggcccccactgctctaccaggtccaggggagtcttgatctctcctagtgtgcccttgctgtttgaccaaattgaggcatctcatccaccagtgacccatcctgaacaatccgaggtgccacccatcctaatgacttgtccatccaaacatgaaacatacaattgcttagaggggatgctatcactccctctcagagaatggtggtgggcattttctccaccaacatgagggagggacaatgattgcttcccccttgcctcaagcaaataacagcttcagaaaacttagtttatgtatcctggagttagagggacactaggactaggaccactatctgattcatgcaaatgaagtttaagaacttgggtcaggatctgcccagatcaaaacgtataatagaggactgccttatgacacttctaacacttgcagaggaaagaacagtgttttcatggtcaatatatagacgctgcaaaagttagtgaacaaacattgtattaaaaggcaagctcccaaaaggagaacctggaaagacagaaaactccaactgaagtgagggccacataactctggggttttcggggaagtctagtgtctagtcagaagctcaacccacagacccttcaactaaagggaggcagaggctgggtgcagaggctcatggctgtaatcctagcactttcagaggctgaggtgggaggattgcttgagcccagtagtttcggaccagcctgggcaacagggcaagcccctgtctctacaaaaaaataaaaataaagggagacaggcactagtatctggctcacacaggaaaagaagacggggatagagctgccctgcacaaacagtgactgtgttctccaaggttggcatgagcctgacatgtgtcttctgcagttagtaagacataggaaataacgtttgactcatgcaaatgaagtcaagaacctagggctgaaaatgccaaccagaatatacaatgagagagctgacttgaaggtaaactgtacttcttctacgtaaagaagaaagttctgtgttttccatggtcaacatgacaatcccgtgaaagtgagtttactcagattctcttaaaaggaaagcgtcaagaagtgcccaaagaggcacatgaccccaacagcagtgtggctcacaacagattacagactgagggggagtctagaagccagctagatgaaaggcaatggatatggtaggagccagccagttccttttggaagctcaaaatgcatccatgagaatgtcagctcaggatttcttctatatcacagaatccaaaagcctcattgtaactttggaaaccatataagggtgtgctcttatgcacattcacctctctccatggagaccacatcaagggtgttggtccggaggagaaagtagatgaaaaccagaaaggcaaaaagaggtaaaatctgtcaatcccatatatacatatacatgcatcacctgctagactaaaaactcaatcagaaaccatcttggagtagacagatatttcccagtattcaggagtgtagggttttaattattacactagacacagcttctaagagtgtggaagttattacaggatgttcagtcattgaagagcaaccacacagctataaacactttccaaagatttcctgccagacatgggcaagacagatccccaagccagttttcaatgtaaggaagggaagaaagtaaccttctctttacccttagcaaagtttcacaaagtattgatgaagatctgttctggaaggaaatcctctctttggatttttataaaagggtctggcttccatttccctgtaaacattgtggaatgataatatcaaaaatgaccaaacaaaaagacacctttcttggaatgggctgtgcaaacatggccaaatacttttgagagggtcaccttatctgttacactggagattataatgataacttcacagttattgtactcaaacaagagcttaaaaaatgatctgtcatacacaaccaggaaaatctgataatatctagaaaacatgttgagaaaggtcatggaagatagcagacttggaggcaccatgaataggcaggtccatccaccagaacaaccactgagctggcaagaactatctgaagcaactattataaagctctggggtctagttgaacaattgtagtatccagaggagtgcttaataaagaaagggcaggaaattttggtgaatgtcagtccctgggaacttcaagtcccccagaattaggataaggaaacgagtgtctgactcacttaggaagagaagttgggtctgaagttgcccatgcctcacttgggtgtgaactacaatgctaccaccagcaatttaaaaaaaaaaaaaaaaaagctgtgttctctgcggtggatatgtggacgcatagaatgggagtggggtgggcattttttccacttttgtgagggagaaacaaagattacttgactgttgcttcaagcaaataacaaaggccttcagaaaactatagcaatattcatgagatttcaagggatacaaggcctagtgtctgaattacaaagcgagaaaacacagggctctacctacactgctagaagggtcaaggtgcagtacttccacttcctgcagaaattaccttatgacagcctttcaagggagataggaggcaaacgggacactaactcagaggaacacatcacagtcttcccatcctctagcattctgagaggaccacagggtgttctgccacactcagatgagctgtacttcaagcttttccctgcctgcatgacctatatgggtatgtataaggtcgaaagggtaaaaatgcagagccaatgtcccacacatggataacaccgagcattactcctcctggaacacccataagtcataagatcacccccttatttgaggatcctgctgctatccatcacatcacatgtttctccttagaacgctaaccatatgactagagacccatgacagaagatgaaggagagcatgactggtacaagtgcagcagcttcaataaccttcactcaaaaccttggagtcagagggacaaagacattaatgtctcactcacatatgaagagaatctggggctggaactgctcctgccagaaggtacaaaaaagaactaactggggcgtgacatgcactaccacctccttcagaagacaggtttgttttctccatgtggatacatggatcccgcaaaagggattttctatatgctgaagagagacagagatcacttccccctttcttcaagcgaatgaccaacagcttcagaaagctagccttgtaccttggtagaaaaacttggtttagtggtttaagccttgtgtggcagttagatcttaaaggacaaagcagtatattggtagttgtcaatatagcagtgctagctctgtttatataaatagagaaatggggttagccatagaggttaaaactacctggttatcccatatattaacccaaactgggtcttggatacacagttgtatttaacgctttacgatctagcctttccaacacaggcactttctgaaaaacctttgtcctcatttgcagcattttgttgtcgggtttcaccgtgttggccaggctggtctcaaacttctgacctcaggtgatccacccacctcagcctcccaaagtgctgggattacaggcatgagccactgcacccatcctgtcactttgattttaacccagtaagtgccagacttctaacccctagaattgttaagataatacatttgtgttgttctaagccatttagtttttggcaatttgttacagcagcctgacactttgattttaacccaataaaaaccatgccagaattctaaccttcagaattgttaagataataaaattgtgttgctctaagccaaacagaaagagagaaagaggaaggaaggaaggaaggaaaaagaaagaaagaaagaaagaaagaaagaaagaaagaaagaaagaaagaaagaaagaaagaaagccagccttgtattcccttaagtttgcaaaataagtgaagtcaagaaccaggggctgaagatgccatgactagaaagtacaataaggctagcttggacgtaaactgcatttccaccacatgcagaagaaagaacagtgttttttaatatccacatatggacactaggaggatgaatagcctgagatcatattaaaaggaaaggatcaaagaaaagcacatgggaagaaaagaagtatcccagctgaaggatgagtcacaaaatcacaggagctagggtgcatctgatgaccagtcagaggaaaagcacattcttgaaagcctgcattgaatgggatgtcaacccacaccctctcagaaaagaaccttgccaaaggctccaaaggccaagacaataaatgccaaatacttccatattatttttttgtttgtttgtttgtttgttttttgagacagagtctagatctgtcacccagttggagtacagtggcacaattccagctcactgcaacctcagcctcccaggttcaagcgattctcctgcctcagcctcctgagtagctgggattacaggcgcccgccaccacgcccagataatttttgtatttttagtagagatggggtttcaccatgttggccagactggtctcaaactcctgacctcaagcaatccgcctgcttcagcctcccaaagtgctaggattacaggcggtgagccactgcgcccagcctacttccatattctaaggtgagttgctaggccaacttaaaaacaaatggacgtaaacaggttctgctggtattaaaccatcatccaccacagagatataaaagagttgaggtggaagaaggaggaaagaatttttaaagagagttgttcaaaatacggaacacagtacttgatcaggattcagaaaacccatactcagagtctatctctgacatttctaacttagtccccttctctaagctcagttttcacaactccaaattaagatgggtaagtcacattacatattttctggatttctcccaggtcctgggttttacattatcccttctagtgccaaagttccatattgttgttttctggatgcctgagatgttcattcctgattcttaaccctgccactctacccaggtgatttctacacttagttacaaccatcttgtcttagttacaaccatcttgtcttcaggtactcaaatgtaacattctgaggaaagtttgccctcatcactcagtcacccattctgaccccactcaggaataaattctgtgttctatataatgggctctcatggtagcccgtttttcttcccaagagaatcaacagagtacttatcacattacagttttacagttatacaaccaaactgtaaattactgataactcccctagtcttttagtactttaagggcataaacatgtccttttggttagtacctattccatactgtgatatgcattcagaattattccagaaattagtagttaatataatgtcatgttttaatagattaatttgtataaccaagacagagcaagaataaatgtcaatgacagaatagcccacaatggtacagataatggaggaagacagttggagatggatagacttctaggggctcctggaatcacatcacctaagtgactgtatacatgtggatacaatctgctccatgagccaaatatcaactcccacaaacttgatattttaagaatagcatagaaagatgcatgtgcctggccagtggggaatacaagaggggatttccaggaattagtgtgctctctttttctcttcctccaaaatgtaaatgaaaaacattttgaaatcttccattcacatgtcctttcctcctaactttgactactggtacacatgttggataattaaaacctgacaatattcgactagaggctaccctcaaagttgaaatggtctaacataaaagtctaagacaatcatttgtgactctcaattgatgagccttagtttactgtccttgccttgaactcctacatttttcaccgaatctaacatttcatttcaatgattaataagaggacctacaacactgagtatcaggacctgtactaagattatatacttagcatctaatatcatctttaacacataaggagaatcatgacgtatctcccatggaaaggtgaagataataaggctcagagatttaaaatgcctctcccaacaccacaaggccaataagtggtagagctcagattgtaaccaaaaatgactgactcaaaacctatgtgtttaggcaagagaatgaggaagccccacaccagatggatataccaccccatgtccttctgcgcaggcaaacctcctcttttagggtaactgtaaggccacagcagtatacaatcactatcacttgataggatcataaagctatgtcctagaacagaagaatatttgaaatgtataaactgtataaggaaatataaggaaaactctcctggacattgatgtaggcaaagaatttatgactaacacctcaaaagcaaatgcaacaaaaacaaaaatagacaagtgggacttaattacactaaaaaggtcctagacagaaaagaaataaccaacagagagaaaagacaacctgttgaatgagaggaaatatttccaaactattcatcttacatgggactaatatccagaatatataagaaattctaacaactcaacaggaaaaaaaaaatcttaaaaagtgggcaaaggacatgaatagacgtttctcaaaagatgacacaccaatagccaacaggcatatgaaaaaatgctcaacatcactaatcatcagagaaatgcaaatcaaaatgtattagtctgttttcacactgctgataaaaacatacccagctgggcgcggtggctcatgcctataatcccaacactttgggaggccgagatgggcggatcacctgaggtcaggaattcgagaccagcctggccaacacggcgaaaccccgtgtccactaaaaatacaaaaattggccagatgtggtggtgcatgcctgtaatccccgctactcgggaggctgaggcaggagaatcatttgaacccgggagacagaggttgcaagtgagctgagatcgggccactgaacttcagcctaggcgacacaatgagattccatctcaaaaaaaaaagaagacataccaaagactgggcaatttacaaaagaggtttacttggacttaaacctcttttgtaaattgttccatgtggctgggaaagttccacatggctggggaagccacgtaaattttgtaaattgttccgcgtggttgaggcagttccaagtggctggaaagcctcataatcgtggtggaaggcaaggaggagcaagtcccgtcttacataggtggcagcaggcaaagagagagcttgtgcagggagacttccgtttttcaaaaccatcagatcttgtgagacttatacactatcatgagaacagcacaggaaagatctgtccccatgattcaattacctcccaccaggtccatcccacaacatgtgggaattcaagatgagatttgggtggggtacacagccaaaccatatcacaaaactacaatgagagattatcttatcccagtcggagtggccattaataaaaagacacatacaaaaaaacagatgttggcaaagatgcagagaaaatggaacacttatatgcttttggtgggaatgtaaactagtacagccactgtggaaaacagtatgcagatttctcaaaaaaactaatgatagaattaccatttaatccaacaatcccactactgcatatctacccaaaggaaaagaaatcaatgtatcaaagagatacgtgtacatacctgtatgtgcatgtttatcgtagcactatccaatagcaaagatatggaatcaccttaagtgtccaccggtggataaactgataaataaaatgtgttatatatacacaatggaatattattcagtcattaaaaaattaaattatgtcatttgtagcaacacggatggaactagaggtcattatcttaagtgaaataagccaggggaaaaaagccaaatatcacatgttctcatttacatgtgggagctaaaaaatttgaatacatggaggtatagagtggaaaaatagataacagagactaagaaggatgaatggagggaagagaggaggatgaagagaattgggttaaagggtacaaacatacaataagatggaaggaggccaggtgcagtggctcacacctgtaatcccagcactttgggaggccgaagcagtcagatcacaaggtcaggagtttgagaccagcctggccaatatggtgaaaacccgtctctactaaaaatacaaaattggccaggtgtggtggcgcatgcctgtaatctcagctactcgggaggctgaggcaggagaattgcttgaacccgggaggccgaggttgcagtgagccaagtcgcgccattgcactccagcctgggctacaaagcgagactccacctcaaaaaaaaaaaaaaaaaagatagaaggaataaattcagtgcttggtagcaaagtaggataactatactttacaaaatgtattgtacttgagtgatggacaccttaaataccctgactttattagtatgcataatatataatggttaaatttcccatgtatcccataaatttgcacaaatttaaaaagagtagtgactgaagattcagttagtcagacaccttcttaaacatctgcattgaacaggatgttgaaagcaacatatcctgtcatgcaagagatatgacaaagatccaaagggtgaatcattaaatgcccagtataactatattgtacattgaggagacaggccatcttgcaaagaaaaagaccataactggttctgctggcattatcttatggccaaaggttaaaaaaaaaaaagtttcattggaaagaatataaaatgtttaagtgataattgtcaatgtggtatgcatattctctaccatcatgaatctggttctcatcatgagtctggttctcccttcttccaaaaatacataatcaaacattctaattaaatggaaggtaaccttctagcaaattaccagaaggaactcaagcccaatctgactttcttaaccaggtgttccactgggagctgatcattagtagtctatacctctttttcaatatattatttaagaatccaagccatctttcaatagtacctgctacctattatacagggcataaatggtccagcagacatcccaggtagcttcccaagatgagtacttttttcctgtaaacctggtatcactgtcagtgaatccaaacatgaagcaaagtctaagagtattcttttttcttcaccccctcaagcatttattctttcagttacaaacaatccaaagaaaagaggcttgaagatttctcaaagaacttaaaacagggctaccatttgacccagcaatccaattactgggtatatatccaaaggaaaataaatcattctactaaaaagacaagggcacttgcatgatcatcacagcactattcacaacagcaaaaacatggaatcaacctctgtgcccatcaacagtagactggaaaaagaaaatgtggtatacatacacatggaatactatgcagccataaaaaataacaaaatcatgtcttttgcaacaacatggatgtagctggaggccattatcctaagtgaattaacgtagaaatggaaacccaaataccacatgttctcacttataattgggagctaaacattgggtatacacggacataaagatgacaacaatagacaatggggactattagaagtagggaagcagggcaagggtttaaaaactaattattgggtaccatgctcactacctgggtgacaggatcaatcatacctcaaacctcggcatcacgcaatatatccatgtaagaaacctgcacatgtaccccctaaatctaaaataaaagttaaaattatattttaaaaataaaataaataaagttgtattttttttttaagaggggttcttttaagaaaagggagcacacaacggagggatacattacaaaatcctagggactaggatccctcttgtggccactcagagtaaaggcacgttcctgaaagcctgcactaataaataagatgttgaatacataccctctcaggaaagaaactcggcagaagctctgttatggattgaattatgtaccccctaccaaaaagaagaagctcatatgttcatccttagcaaccagttcctcagaatgtatccttatttggagaaagggttttaaagatgtagtcaagttaaaatgaggtcactaaagtagccctaatccaacatgaccagtgtccttataagaagaatcaatctggacacaggcacatatatatggaaaacacatgtgaacatatagacagtcaactacaagccaaggaaagaggcctggaacagattattccctcacaaccttccctgaattcccttacaaccaatattgccaacattttcattgaatttcaggggatttctaggcctagatgtgtgaaacaaaaaatttctgttgtttaagcctccacattttggtactttcttatggcaactctagaaaatcaatacagtttccaaagggcaagacatatcaaatattcccatattcttgccactgcactccagcctgggtaacaatctgagactctgtctcaaaaaaaaaaaactcctgtattctaaagtgagctgccgaccacctagcaaataaatagaacgagtttctgccagcattagcccattaagccatgtcagaaatataaaatagttgaggtagaagagagagaaaaagaatttttagagttttgtcagtgtgctggacattctgcctatattcatgagggagggtcaatggtttgtgcccctttgccacaaaccattgacaaagagcttcagaaagcctgactgatgcccatgaaggttgagagacacaggaactagtgtctgactcacacagtgaaaatcaagaggctgtggctggagatattcctggaaaggggacactaagagtacgacttgtgagagaacaagcaattccaccaattacaaaagaaggatgttgatttccagggtcaacatgtcatcctgggaaaaagagaggcctgataagtacttcataaggaagccactcaagagaactgcctgcagaggaagaaagaccccaacagaattagagctcacaaagtccttgggattgagaaggactctaagtgataagtcacagtgaaggcattgcatgtggcaggaatataaaatctgaggtatctgaagaaaggaaaagtgcttcctaacatcatcagttcgtgatttcctccatatctcagagcccccagatcatactatgtctttgccaaatatgccagtgtgtgttcttctccctaagtctttcccactgtggggatctcatcaggggaaagagaatgagcagtcaactggggtgcagatgcagaaagaacatatgcacctggggctgaaagatcagtccccaagattcatgaattgaggttttgattattatactgaaataggcaggtttcttacagttgaaagtggctcaggacacttcgctatgtaagaataaccagaaaaactatgggacccaccttagctttcttcccaaacatggaaagaacaggtctctaagccagttttcacagggaaaaagaaaaataataaactactttcttttgacccagttgacatatttcaacaggaattctaatgaacaaacagtgataaaattccaatctgactatgctccaaggtttatgataacccagaagtcatagtgaggaccgcaggagagtcatataggtgtgtactaaggataccatgaggcaagagattatgaaacattatgacttctcagctatccacaaacatatatttctagtattttataaggccttcaaaattatgaaagaaaacatctaaatcccaccatgtcacattacgatggaaaaatcgagtacaaatgcaaaaactggtgtccatcaatctgcagggctccccagtatagtgagttccaattgacatgattccagaagctgtggtaaaatcaaaggtatataaacaccaagtcttcttaagggacctttaaatatacaaaacagactccttgagaaaactcacaataaaaagtacccaggcttgaaaactcagggacaacttcacactggaggtgacccagtaaaatttctctctgacaataaccaggagcattcaggctcagagtgatctgaaagcagtcatatatgtggaagggtctgcatgcacattggcaattcctacaatgggaggcaaaggaacagtggctttccctcactttatccatcaccactttccagtattcacctttgtccactcttcctccccttctctcctacattcccctatttctctgatttctcctagtctctcctattctcccacactatgccaaaggatagctgtaaagagtacagtggttctctgacttagatcaggatcccaatcctgcaaggacactttcctaaagctacatgggcacagagtcctaatgaaacacatttcccttctcatcttccatatgtaggttttcttaaagtatatctacctacaaaacatcctgggcctctgtattagtctgttttttttttttttcacactgctgataaagatatacccaagactgggcaatttacaaaagaaagaggtttgattggacttacagttccatgtggctggggaagcctcacaatcatggcagaaggcaaggaatagcaagtcatgtcttacatggatggcagcaggcaaagagagagcttgtacaggggaactcctctttctaaaaccatcagatctcatgagacttattcactatcacgagaacagcacaggaaagacttgcccccatgattcaattacctcacaccgcgtccctcccacaacacatgggaattcaagatgagatttgggtggggacacagccaaaccatatcagcctccataaggtttcctctcttccttctcgcaatcaatttctcccattttaggaaagcaatgtgaaaaggctcacccacccagttcttaaaaggtgcgtttctcaaaatgtggatgccatagatctgaattcaaagccagtctctgtcagtttctagctcggtgtcctttcctaggctcactttcctcctctctaaattaagctgagtgctttatgttacacagtccctgcatttcatgcagttcctggagtcactatatgccttccagtgtcaagacttccatattgttttctgggtccctgggatgccctttcttaaaccaccctcctctacccaggccatttcttcacctagtttcaccctccttgtcctcaggtgttcaaatatcacttcctcataaaaccatttctgaccactcactctctgtatagcactatgttacagctgtccaagctaacatctgcatcctatcctgtaggtcaccaaggaaagatgaaagcagtataaagaaaagtatgttatcattgtagcagttattgcttaacatctaaacacttatacaacattggtttacagtctgtgaatgccactggaggtactcaaaagtattcctgaaattatgtcatgaagatatattttttgcagttttccctctataagcattatcaggactcagcaagaatgggactttcctcaatacaaaacataaatgattcaatgagaagacttcagtcagtggcacaagctgagggagacatttggagatgcacgtgcttttcacgggatcatggaatcacattcagtgagtgactttctacatatggataaggcctgctccacaagccaataccaatcagtgctaccttgattttttaaagacaatcaaagaaaaacacaagtgccaagccatgaggaatactcagagaggtgtcccaggaattagaacgttctctcttgctcattctccaaaatgtaaattaaaacggaaatcatgtttgaaatctgttcttcctattatacaaccttgactacacatacaaatgatgaactattaacttactcatatttgtctaggggctacattcaaagttcaaatgtcctaataccaaggtgtaggacaaccatttgtgactttcagctttaggaaccttagctcacactcctttgaacttgtacgttttatactgaatctgatattttattcattcattcattcattcattcattcatttatttatttatttattttagacggagtctcgctctattgccaagccagagtgcagtggtgtgatctcagcgcactgcaacctccacctcccaggttcaagcgattctcctgcctcagcctcccaaatagctgggactaaaggcctgcaccaccatgcccaggtaatttttgtatttttaggagagacagggttttaccatattggccaggatggtctatctcttgacctcatgatccacccacctcagcctcccaaagtgctgggattacaggcatgagccacttcacctggccagaatctggtatttgattgatatattgcagaagttttacagtattaaagtataaaaagctgtgctaaggctttatatttaacgtctcacttcagcatcaccacatagaaagggtcaagaaatatctcccatctacacatagagaaacttaggatcaggtctagtacttctcactaggagacacaaagatcccttttatattcatgtttagctgccactctgggaacatttcccaggatttcttgtcttcacgtgctggaattggaatcacttggttgtttttgagccagatcctgatggattatcatgccctgtacaattgtcctaacttgggcagcgcagacctgtttaccttattaactttattagttcccatcctcaaagggtcattatccataggcatccacatgggcatgaacaggagaaatgttacttgagaaatctgctggtattttttgtatacataaggctgaaacttgaccaaccatttgtcatgctaccaggcaccaatcatctaccctgtcagcccatgggcacctggccagatgtgagccaaaatgtaataaggtgcatttacagggaggctttccagcacaagcaccgcagcccatatcgccacccattaagcagaattcccttttccatgcacaggtccaagcagatttcttgggggttgcacagcttctgctgtgagtagaaactgtctgcctttaacttatggatgcgtccataaaccagacccaggtatcccaggaacctgagtgttccaaagccaccagaaacctgagatgctggcatagtccctgcatctgagacagccacatctagagggtgactggacactttttcctgtacctctgagacactattaattcctgtttcacatcttcccttgatatcccacttttacttaaaaatggatgcttcttgggaaatattcactttgatggtgttctcatttgacaccaaattcatgatagagaaagtcaggagaaaacacctgttcttgctttgttactctcacgatgttcaccagcaacaactaacaagccagaaatagcctctcaaatggggtatatcaggtagcagtttcaggcaaaggccacaaacaaatcccaaagcctgccttcatctaatggccacatctttttgctacaagttcctatctgcataaatgccaatcggtgccactttccctcaagacttggttcatgtggaaatgtgttctgtacatccttcaggagagtttctaaggcatgtttttggtaaaactgaatgccattctagtaattttatgtcattagttaagcaagttcctatgtgagaaatgaagtatatccaatacttaacaagcctatcataaggtgggcttttttatcatatgctgttcaaaactagattagctggagtttttttagtccatcggattctctttaaagactcaaggattgcactctgagcatcagcccacattgttcacaaaactttatgtcagtgtctagttcccaattcttttcagggtttaatcttccagccctagtcactcagatatctgaccatctacccttcagcaaattgtactctatccttaaaacttccatttagaatcatgtcatccatgtagtagtatcaagacagcgctggtaaggtttcaatcttttccacgtctagactatgtccacttgtgaaaaatcttggagagtatagattctctgtggcagcatggtaaacatatatgtaatgccacatttagaacccaaacttgctttcataagtacgtgctcctctgggacctgagtttctcttttccacttgtcttattcagtctcatctctaagaatccaagccatgtttcaatggcacctgctatgaaggcccatgaaggcaaatggactctgatcccatggatgcagtggttacttgaataaagcattaacgtgtccaccaccattaaccagcgatcccagtctttgcaatggatgagagagcatcttgatatcaggaactgcaagtgcaaaaaagactactgtcaaatactgtcaaattaaactgatgatacagcacagtgagatgtgaagaatccttggctttttcagggacataacagggctattctaaagtcatacagtctcattaagcacctctgcctctattacatccttgatcagggtaggaacctcctcctttcaccctcctcccctcgttgtccctcgccacaacgtagtatcctacactgctttatttatacctcatggctgagctgtggaagcctggtgggctcccggttgtccactcaactcactaccactgagatggagtagtgactctgtttttagggactatttccctgagcatggaaataaaggaaaatcctgagttcccttcaagggaaattccaggcacccagctagccctgagaagtaaataagcaacttgtttaggaaaagggtaacagtagcctaaaacaatagccaaggaagttagagtccagagatgttggttcccctatagaaattaaagataacgtcttggccaggcatggtggctcacgcctgtaatcccagtactttgggaggccaacgcgggaggattgcttgatctcaggagctcgagaccagcctggacaacatggcaaaatcctctctctatcaaaaatacaaaaaattagctgggcatggtggcacttgtctgtactcccagctactcgggaggctgagatgggagggtcacttgagcttgggcagtggaggctgcagtgagccaagatcgtgccactgcactccagcctgtgtgacagagagagactccatctcaaaaataaaataaaataaaataaaataaaataaaataaagataatgtcttaacatatgtcccgagttatctttcagaaacttggacccccacacacacatactgaggacccccacgaaatggatccactggcacgtagacttcaaataaaggggaactgaagactgttcagtggtgaactctgaccactgttctctgttctaaatttcttcctgagggccttggagtcacactccaaagccaattaacatttttttctgctgacccaaaatttttaaacaaagctttccttccttaaccaattgcaaatcagaaaacctctgaatctacttacaacttgtaagccccgcttcaacatatcctacccttttaggccaaacccaatgtgtaacctcgacgcattgatttatgattttgcctgtagcttctgctttcttgaaatttaaccctgcctttaaaaagccttacctgcagccaccaaagaggtcagtatttgagcaatagctgcctagttctccttgcttggcattctgcaaataaacaccttcttttctattgctgcagaaacctcagtgtggatatctggttttactacatcaggcaagcagaccccaatttggttctataacaccactgttccaatcatggcatttccccattggaaacatcatttataatcaagagaagaatcacaaatacttaacacagctcttcccacaatccactcaatagtatcagttacaacatcttgcgtgtactgttccataagagcccacgcataaacttacatcagtctaatttgagacttatttccacatccaaagtaaaaattgtaccatgcccatggaggcttcaaggcattacagggacttgtgcctcagcatccataaggactgaaaaagtttggaaagtgatgccaagcctccaacacactttgacaagtggataaagcctctagttgctattagagaagaatggacctcacctttaccctagacctatttgttcttttttttttttttttgagatggagtctcactcttgtctcccaggctggagtgcaatggcgcgatcttgactcactgcaacctccgcctcccgggttccagcagtcctcctgcctcagccttgcgagtagctgggattgcaggcatgtgccaccacactcggctaatttttgtatttttagtaaagatgggatttcaccatgttagcgaggctggtctcgaactcctgacctcaagcaatttgcccgcctcggcctcccaaagtgctgggattacaagtgtgagccaccgcacccggctatttcctcttgaaagaggagaagtctgggtagaaatgtggtgttgaaggtgttagatcaacaacattccaaacagcacagacattagcaaggttttctaggtcttcttggtctccctcatatcatcagcaatgtagtcatggccaggcaggcttaaaacatcaggtagatttttaggcaaaatggtgatctccttacaacactgggtaggtgattaggcaaaacaatgatctccgctcactccctccaacacgactgccagtgctccctcatctgtttgtggaggaggaaacctctatagactcatcgggcttttactcaaacctatccttcatgttccttccattctgttcattgtagaagtagacttcagaatatctctatataagtgactgcactctaccagcagctactgttttccttgtggtcataggtaatggccaggggaaaactgtttcaatttcccagtaacacagatggatactcaacaaagaggaattgcatttcttagatttatgtctaacatgaactatcaactcaagacagcacgtgtctcagagacaaaggtgaaagatcacatggcccttatcatcaaataatttatcaatgtggtctgtttatgagtaccagtgttgtgaacattaaggtgttttctattctgcagcactattctggtggtggatgggcagcacaaagcccccatcccaaaagaccacggagaagatgaaaaactgcctcataaaaacttttcaaggaggatacgtaggtgagtggaagatggcctcagagcaatacctcacaagcttcctatcctcttgcattctgagaagactgcaaggcattctgccacatttagataaaccatgctcaagctctgccctatgtggcctatatgggtatctgtagggtgaccaggacaaaatgtagatgcagtgccctacacatggataacacctgggagttcctcctcctggaacatctgtaagtcaaaatatcttcccattcatggtggaagctgatgctgtccattacccaccatgtgttactctatagaactctaagttgtataactggagacgcaccacgatgaaagaggggaagagggatggtttgaatgacactagtgaaacagcatcagtaaacttcactcacagccctaagttataggaatatgagattagtgtctgactcattagaaaaaaaatctgaggctgtatctatcctttccagaatttacaaaagggggctcattgggtagtgacttctatctcctgtagaagaaaagcttatgttctccatgtggaaatatggacaataagaaagggagtgtgatgggattttctccaccatcaagaggaaaggatgaaaagaacttcctccttgcttcaaacaaatggcaaagagcatctgaagccttgtcttacacccctggagtgttgaaacacaagggttagtaataagttcatataagcgaagtcaagaacctggagtttaagcttctctgccagaagatacaataagaagctggcttgagagcaaactgcacttttgccatatgcagaagaaaaggctgtaatttccagtgtcacatgtggaggctacaatattgaatggcttcaaactgtattaaaactaaagtacccaagaagaacccttggaaataaaagaggaagccctacagaaaagtgggccaaaagttcccaggggctagggcacatctagtggccaggcagaggaaaaacattcctgaaagcctaccttaaataggaggttgaacacaagccctctcatttaagagatttttcagatgctctgttattgattgaatcatgtatttcaaaaattcagatgttgaatacctaacatctagtatttcaaagcacaaatttatttggaaaccggggggttacaatactaataaagataaaataaagttcttatagtggtcctattctaatatgaatagtgtccttataagaggagatttagacatagacacaaatacaggagaatgccatttgaacatgaagacagccatctacaagccaaaatgagatggctggaccagattgttccctcacagccctcagaaaaaataaacccagccaataccttgaatttcaacttctaatcaacacacacacataatatttgaggtagagagagaaaagaattcttagaaagagttgttggtatggtgggcattttctccacatttgtaagagaggaacaatgattgcttctcacttgatgtaaaccactgacaatgagattcagacaagttgactgatgcccataaaggttgagggacacaggaactagcaactgacttgtacaaggaaaaacagaaagctgagactgggggtgcccctggagcacagcaaaagcttgcctggtaagtgaacagcaattctaccatttacaaaagaaaaatacttgatttccagaatccatttgtggacctgggggaagaaaagagcctgagaatacctttaaaggaatatcagccaagagaaccacatggaggtacaaaaagagctcagtactggtagataccacaaaaggccaaggaactatggggtggggggggcatgcagtttaagtgaccaatcagaagaaaggccccgcatcgggcaggggcatgatgtctgaagtccccatgagatcttccactcaggatttcttatctcagaaccccatacctgcattacaaagcgaatcatgcaagagtgtgattttctccctgagcccttctcttgctctctcaaggtctcatcagggggataaaaataagcaaatactcaactggggtatagatggagaaaataaaggccaaaaaatgggtgccatttccactcccaacccatatatgcacgtcacccgcaggattccaatactcaagcaagcctcatctgggagtagaagatcttgcccaagattcaggaaatgatgtattgattattacactagaataagcttcttacaagatggaagtagccacaggacattcagctttatgacagtaaccagaaaagctatgagaacatcctgggcttttttcccagacatgagaagaacaggtaggcaacgtggttttcataggaaaaagaatgaagttgctttctttttgttagactttattcacatcagttcaacaggacttgaatgaagaaacagtgatcaaagtccaatttgactatgctccaaagttatatgacaacctagaagtcatattaaggactgcaggagagtcatccacattgtcactatttgatagcacaatgccagagataacgacacactgcgacctttcaaccatccacaaatatatttttctattactttctaagggacctttaaaattacaaaagaaatcacctagtaccctgaagtgtcacattacaacaggaaaatggagtaaaaatgcagaaactggctgggcgcggtggctcacgcctgtaatcccagcactctgggaggccgaggcgggcggatcacgaggtcaggagatcgagaccatcctggctaacatagtgaaaccctgtctctactaaaaatacaaaaaattagccgggcgtggtggcgggcacctgcagacccagctactcgggaggctgaggcaggagaatggcatgaacccgggaggcagagcttgcagtgagccgagattgcaccactgcactccagcctgggtgacagagcaagactccgtctcaaaaaaataaaaaaataatttaaaaaaaatgcagaaactggtgttctataaaatgaagggatccccacagtagccagcccagtttgactagatgcctgaaactgcagtgaaatcaacagccaacaaatactaagtcttttaaagagacatttaaatatacaaaacaggctgcgtcccaaaaccctcaagtccaaacatcacattttctccacattcatgagagaggaacaatgattgctttccccttgatgcaaaccattgacaaagagattcagaaaagttggctgatgcccatgaaggttgagggggacagtaactagtgtctgaactaggcttaaaagtatggggacggccaggcgcggtgactcacatgggtaatcccagcactttgggaggccgaggcaggcggatcactggacgtcaggagttcaagaccagcctggccaacatagtgaaacccctgcctctactaaaaaaatacaaaaaaaaaaaaaattagccaggcattgtggcacgcacctataatcccagctactcgggagactgaggcaggagaatcacttgaacccaggaggtggaggttatagtgagcagatatcacgccactgcactgcagcctgggcaacagagtgagactctgtctcaaaaaatatatatggggacataatcacactggagataatccaatatataaattctctctagaataaccaagataactcaggcccagagagagttaaatgtagtcacatatgtggagggtctgcttgatctctgactactcctacaaggataggataaagaaacacaggttttaccccactttactcaacctcaatttcccagtattctctcagtgtcctcttttctctgctccttcctcagttttcccctcgttgtctactttccccacatctctcccattctcactcattccgctagtggtatttataaagaatgcagtggttctcaggttaggtccccaatgctacgggaggcttcttaggagtacctgggtacagagattctaaaataatccattttgtcattcctatcttccatatgtatgtgttcctaaataatatccacctataaagaacctgagcctcaaccagtttctcctctcttgcttctcataatctcccttttcacttctcctatttaccaaccataaacctcttagacagaaaaatatttgtaaatatctgcaatagtgtgttacataagagtttcataagtaaaacagcaggcgcaggataaaccataaaaaatatgtgaattggaaatcatcataattaaaatcttttgcgccaaaggacattatcaagaaagttaagacaatccacgaaatcggagaaaataattgcaaattatatatgtgataaggttgtagtaaccagaataaacaaaatactcttaaaactctacaataaaggacaacccaattttaaaatgggcaagcatatgaatacacatttctcccgaaaggatatacaaagtcctaaaaagcaaatgaaaagatgttcaacatcatttgtcattagggaaatataaatcaaaatcacagtagataccacttcacatctactagaatggctataatcaaaaaacagggacaataacaaatgttggcaaggatttggagaaattgaaagcctcatacattgctgacatgaaatagtgcagccactgcagaaaacactttggcaggccttcacaaagtcagagttaccatatcctacaattccaatcctaggtaaatacacaatagaattgaacatatgttcatagaaaaacttattctcaaatgttcatagcagcattatccacaatagccaaaagtggaaacaaactaatgtccattaactgataaatgtatagagaaaatgtttatacaatgaaatattattcacccataaaaaggaatgaaggattgacacatgctgcaacatggatgaacctagaaaacaattatgctacatgaaaaaagccattcacaaaaggtaacatattgcatgattccatgtataggaaatatccacaataggcaaatccatagagtcagatagaagattagtggttgtgaggtaatgggaagtaggggcactgagagtgactgctaatacatatagggtatcatttctggaataatggaaatgttcttgaatgagacagtggcaattgttccataacactgtgattatactaaaaaccactgaactatatgctttaaaatggtgaattgtatctcaagaaaactgtaaaataaaacaataaatatttatcaaactcatagtttatgtgtggatcacgaattcaggaacggctgagctgggtgtttctggcacagggcatctcatgcgattacagtcaagaattcaaccagggctgcagtgatctgaattgattagagctggaaaatctgcttccaaaatggtacagtcacaaggctgggaaggtagtgctggtaggttgtgggagacctcagattcctcccacatgagcctctctgggggctgctggagtatcttcaatgactcggtagatgattttccccagaatgagtaatcccagtgagagacagagagaagcctcagtagtcacaaaacattacttccatcttatatatttaagagaagtgagtccctaagtctggcccacactcaaggtaaatcatatttatcctatcatttcaacttgatcacatagggaaggtattattctctctcatctacggatgaggaaactgaggctcagagagatcaaataaatttcccaaggccaatagctgccagaagtcatttttgtttttgttcttaatgtattttttttattcttatagatttaggggtgtatgagctgtcacactctgtaaagaaatacctgagactgggtaatttataaaggaaaaaggtttaatggccaggagtggtggctcatgcctgtaatcctaacactttgggaggccgaagcgggtggatcacctgaggtcaggagcttgagaccagcctggccaacatggtgaaatcccgtctctactaaaaatacaaaaatcagccaggcatggtagtgcatgcctgcaatcccagctacttgggaggctgaggcagaagaatcgcttgaacccaggaggcgaggtggaggttgcagcgagctgagatcgcaccactgcactccagcctgggtgacagagtgagactcgaaaaaagaaaaacgtttaattggctcacagttccacaggctatacaagaagcatgatctggcattctgctcagcttctggggaggcctcaggaaacttataatcatagcggaaggcaaagcaggagtgaggcatctcacatggtgggagcaggagcaagagagaaagaaggggaaggtgccgcacacttttaagcgaccagatgtcccaagaactcactcactatcacgagaacagcactaggaggatagtgctaaaccattaacgagaaactgtccccatgatccaatcgcctcccaccaggcctcacttccaacattaggaattacaatttgacatgagatttgggtggggacagagattcaaatcatatcaagggggtataagtgcagagttcttacatgcatatattgcatggtagtagaatctgggctcttagtgtacccatcacccaaatagtgaatattgtatccaacaagtaatttttcagccctcaccctctcccaccctcctatcttctgtagtctccaatgtcttttattccactctatatatttatgtgtactctttgtttagctcccacttaaaagtgagaatatggctggccaggtgcagtggctcacgcctgtaatcccggcactttgggaggccgaggtgggtggatcatgaggtcaggagttcgagaccagcctggccaacgtggtgaaaccctgtctctactaaaaatacaaaaattagccagacatggtggtgggtgcctgttatcccagctacttaggaggctgagtcaggagactcatttgaacccaggaggcagaggatgcagtgagccaagattgcgccattgcactccagcctgggtgacagggcaagattccacctcaaaaaaaaaaaaaagtgagaatatgagatatttgactttgtgtttcaggaattatttcccttaggataatggcctccagttatatctatgttgctgcagaagacatgatttctttcattctttttatggctgactagtattccatgatatatacataccacatttcctttatccaaccatccattgatggacacttaggttgattccatatctttgctgtcgtcaatagtgctgcaataaacatatgcagaactcgtttttgaacgtacaaactgctgactcaaaacctgtgctcttaacctccaccattggtgtttcttaaccggacatgctatatgcaaaagcaagatgatgcatgtggcccaaaggaccagttaaatactcatctttggggctggagaccaagcgcctgaatggtttttaagatccctaggtgttgctgaggtgcatcttgggtttagaactaccccctctgagcctgatgggtttctattattaatatgggtagctgactccagctggatggtatgtgccttgaggacagagttcccacctcaaccttccctgtggaacctactgtgacagtacaatatctgcccaaaggaagcaagcactagaaggattctgagcaaccgccacccaggaagagagtttctaggaggttccaagtgaactgaagtattcatgagagatggccaacatggatactctccagtaggcaggagattcactagggcccacttggggtcagtgcctgccacagtcaggggcatctcaatccaactcagagcaaaagggtgtcagaaaataatgctcagcacaaattttctctcgcaactctcaagtgggtctttgtctgggagtgatttgaggccccctacacaaccaaatcctcatgatacccaaagaatatcaaagagtttcaaaatgtacactaatagctaaccccctttggtgttgtatgttccatagcagccatgcaggtgctcttccgaagcctctgtacaaagatgtgtacagagtaatgcacttcggacttaagacctagaatgagaaactttatcagcaatgaatatttctacctgaagtcttagccccttgactgggaggggtgccagatcattggctcctcctggaagaaggcactaggacaactgaaagtgaaggggtccttacacaaccaacacatgtaagttgttgactgctcaaataaagtgtttttccagacctgagactggtgttttcttaccatttgaacagagactattctattgagaaaacaacttttttcagcactttcttttagaagtttgaacccagtgtgtttaccctctccaaaggaaccaatatttcagatgtaattttcacttttccagaatcgttttactaaagatgttatcaataacccagtcactgtgagggtacaacatgtaaccttttgctaccatctagtggaattactgaactttacactgaaacatttttgctttaatacagtcattctactacttcattacctttacccaacaccaagaaacacccctaacaaaaacagcaagataggtccccagtgccttatcccctttggtgctcttcaatgaacaccacctccatatagctttttttttttgaaaaaaatcacaataaatatttattcaatgactttttttttttttttgagactgaatcttgctcttgtcacccagattggagtgcagtggcgcaacctcggctcactgcaagctccgcctcccgggttcacgccattctcctgcctcagcctcccgagtagctggaactacaggtgcccaccaccacgcctggctaatttttttgtatttttttagtagagatagagtttcactgtgttagccaggatggtctcggatctcctgacctcgtgatccacccgccttggcctcccgaagtgctgggattacagacgtgagccacagcgcctggcccatatagcttttttgtataaatttaaggggtacaagtgtaattttgttacatgaatagattgcatagtggtgaagtcagggcttttacagcacccatcacccaaataacatacactgtacccattaaataatctatcatcatccaccccctcccacctccacagtagctttgaactgagcttacaataaacaagcagcattaagtttagaaatctataaaaataactgggatacgtaaagtcactagtagagaatgacagaaaggccaaaaggaactacaagaaagctagcattgcaatgtggtgacctttcagacttctctgtcctaaggacatgatatcagctaatggagagagggcagctccaataatcctctacactaatccactccaaatttggttacagtactaaattgctacatgatgaatagtaaagctatccgggaaagagaaggctagttattgatcaacattcatactctccttcttttacagaattgcaagttttacctgaggaaatgtccaggccccctgctacagactttagccccttgcccttgcctttccttctaggggctacacatggtggtgagcaatccctggccaggcaagagtttaagatggcagcgtaacaagatagcagcctgatgccagtctggagttcccaaccagaattttacatgagagagaaaggaacaagtggagaggttagggcagaaagctggaagcaatgggagaggtcaagagagaagatatgtatggagacatcttcacacttgtgagatttggcaaaggaggagcctgagacgaggagtttaaagacatgtccttggaaaacaccaaaactgagaggttagaaagagaaagactagtcatagaagaaacaatcagagcaacaagatgaacaacagaggagcaccaaagtcacaggggtacagggaccatcagtcttactgtaaaaaaaggcttgagaaaagacttatggatttatatataataaccgtgggatgtcagtatgaccactccctggagctatccgccttttataatcctcccattaccttacctacacagtatgcccagatcatccttatgtggctcactgattccttccatatataccttgtaccatcctagaacatctcccaccctcagacatcctggccacaccaggaacacattattagttatcaccttatagtcaccatcattatcacaatgctccataactgcccacagccaacaagcatggcaaggtgaaataaaaagtaatccagctacactatgaatagagcatctaagagagaacactggaattcaacagagaagtgaaaggaaatatccaaggcatggaaggagaggagaggcacacaaatcagctcagccaggatcagatgggagcccagaggctccccagtgtggggaaagggtaagtgagagatccccagtggtccacattccctctacagactcctataatgctagccacaataaagcccctcaaccctcacaggccctaagactagcatggggagctgcctggagaccatgcgatggcattgctctagagaagttgctcacactgggtcccacacactccccaagtcctaagcagctgtagcatgacaccattttgagagcccaacccccaccatactgcattctgccccgggacccaacagcccctgcatctgtacatccctggagccccactaacatcccctcacatccacccagaggtctgcagcaatatgacaccagctagacacagcaaagcagcaggctccccagcactctggcacacacactgccctgcaccccaggaatgggcagtgcagtgtacccaggaggctgccccaaagacaaagggagccaagtcacatgctcctcagagcctgaaactcgcctgcctggagccacagccattgacagcaaccctgctcccatcaccagcaggactgcaggacaattaaatgcaccctgaggccagattctcccccaaagcagccattgctgctgccaccactaaggacaaaagcaggtaccattgacagtgacttggccccctcttcccccctccgccatcagcaacagggccaacacacacttgcatgtaccctgaggactggctcccccagctgctgctgctgccaccaccatggcagccactaccagagctgaagcacaggctccccagagcctaagagctgcctgcctacagctgctgccactgacagcaaacccatcctccccacaagcagcagggccacagtgcatttgcacataccctgaagatggactatccccgctcgctgccactgctgtgccaccacccaagcacactgctggggagcctagggaatcaccctgccctgcccaccacagcctgtgcccatatggaccactggggagggcctgaaggcaggcctgcccagcctggtaccacccccttcagtacccaaacatgccacctaggggcatgctccttccactactgttggcatctgtgcactcctcttggatacatgaggacaggcccacccagcctactactaccatcatagccggcacctacctgcacacaccaacaagggggctggggaatggcccacccagcctgccataggcaccactatcacaagcgtttgccacccaggagcccaagggttgtcccaccactgctatagccaccatccacgccacacaatgattgggaaaatgagtgggacatggcctctgagcagtttctcataggtctcacatttgctcatgttccagaatggtctctaggcatttcaccacactcaaatgagccatgctagaagattgtccctacatggcctatatagatatgtgaaggtcaccaagacaaaacgcacatgcaatgccctcctcctaggatatgcataagtcaaaaggtccctcattgttggaggaagctggtgctatctatcatccaccatgtgtttctctgtagaactctgatttgcatgactgaagatttatgatggattatgggatggatgatacaaatgtaacaggtcccacaagcttcactcatggccctgagttagatagagagactagtgtctgacacatgtatgaagagaatctggggctggagatgcctctgccagaatatgcaaaaaggggctagctagacagtgacctgcacctctatctcctacagaaaaaaggcttgtgatctccatgtggacatgtggaccctgagaaagaatgacagactttttctccatctagaggagaaaaggcatagagaacttccccctaccttcaagcaaatggcagagttttagaaagcttttcttatctcatgttcagtcatggatagaacatccaagcagaaaatcaataaggaaaccgctgacttgaacaactttatagaccaaatgacctaacagacatacacagaactttccactgaacagcagaagaatacacattcttctcaagggcgcacagaacattctccaggatagatcacgtgttaggtcacaaaacaactcttaaaaaatttaagaagattgaaatcacaccaagtaccttctcagatcacagtggaataaaacaagaaattaataacaaaaagaaaacaggccaggcatggtggctcatgcctgtaatccctgaactttgggaggctgaggtgggaggatgacttgaggccaggagttcaagaccagcctgagcaacacagtgagaacatagtgagaccccccatctctaaaaatatattttttaaaaaaataaaaaataatttaattttctttttttttttttttttgagacagagtcttgctttgtcagctaggttggaatgcagtggcatgatctcggctcacggaaacctccgtctcccaggctcaagcaattctcctgccttagcctcctgagtagctaggattacaggcgtgtgccaccatgcctggctaatttttgtatttttagtagagatgggatttcaccatgttggccaggctggtctcaaactcctgaccttaggtaatctgcccacctcagcctcccagtgtgctggggttacaggcgtgagccaccacgcccagccaaataattcaattttttttaaaaataggaaatttcacaaacacatggaaactaaataacacactcttgaacaaccattagacaaaagaggaaatcaaaagggaactttaaaactacctggatacaaatgaaaatgaaaatacaatttacaaaaacttatgagatgaagcaaaaacgtaataagggaagtttatagcaagaaacatctacatcaaaaagaagaaagatgttaaacaagctaattttataactcaaggaactagaaaaagaaaaaattaaacccaaagtcagcagaaggaaggaaataataaagattacagcagcaataaatgaaatagaaaaacaattttaaaaatcaataaaattaagagttggtattctgaaaagataaacaaaattgacaaacccttagctggactaagaaaaaagggagaagactcagatgaaattagaaatgaaagaagtacaatacaataaatgatgcagaaataaaaaggattataagggattattatgaacaattatacaccaacaacttggataacctagaagaaatgaattctgaaaaatacacaacctagcaaaaccaaatcaagaagaaacaaaaagcctgaaaagatcagtatcacataaggagactgaatccataatcaaaaacctcccaacaaagaaaaggccaagaccacatggtttcatgagtgaattctaccaactactcaaagaaaaaatgccaacccttcttaaactcttccaaaaagtaaaagaagagggaacacttccaaactcattgtatgaggccagcatcatcctaatttcaaagccagccaaagatagcagaagagagaaaaaaaaaaactgtaggccaatattcctgaaacatagatgcaaaacatcttgaataaaacactataaaaccaaattcaacagcacatcaaaaggattatataccacaaccaagtgagatttgtcccttggttcaatatgcaaaatttaatgtgatataccacattaacagaatgaaagataaaaccacataatcatctccacagatgcagaaagagcatttgacaaaatccagcattctttcatgataaaaaatctcaacaaaataggtgtagaaggacttacctcaacacaataaagaccattatgaaaaacccacagctaaaatcattttcaatgaggaaaaactgacagcttttcatctaagatccagaacaaagcaaagatgacaattcctgccactgctacttgacaaagtactggaagtcttagccagagcaatcaggcaagaaaaagaaataaaaggcatccaaatcagaaagaaagaagtaaaattatctctgtctgcagatgacatgaccatacacctagaaaaccctaaagactccacacacacatacatacacacacacaaaaaaaactcttagaactaaaaaacaaattcagtaaagttgtagtatacaaaatcaacattaaaaaatcagtggtgtttccatacactaacaacaaactatccaaaagggaaattaggaaaacaatcccatttacattagcaaaaaaaaaaatacttagaaattaaccaaagagattaaagacttgtacagtgaaaattagaaaacactgataaaagaaattgtaaaagacaaagaatacaaagacatcccatgttcatggattggaagaattaatactgttaaaatgttcatactatacaaagcaatctacagactcagcgcaatccctatcaaaatcacaatggcatctttacagaaacagaaaaaacaaatgtatatggaaccataaaagaaactgaatagccaaagtaatattgaacaagaagaacaaagctggagtcacttcctgacttcaaattctattacaaagctataataatcaaaatggtagggtactggcataaaaacagatgtatagaccaatggaacacaacaagagacccaagaaataaacccatgcatatatgctcacctaatcttcaacaaaagcatcaagaatacacaatagggaaaggatagtcacttcaataaatggtgttgggaaaactggatatccacatgcaaaataatgaaatcggacccttatcttacaccataaacaaaaaccaacacaaaacagattaaagacttaaacataacatctacaactataaaactcgtagaagaaaacaggggaaaaactctttgacattggttttggcaatgatttcttgcatatgacaccaaaaacacaggcaacgaaagcaaaagtaaacaaatgggactatgtccaactaaaaagtttctgcacaacaaaagaaacaatcaacaaaatgagaaggcaacctagagactggtagaaaatatttacaaaccatatatgataaggtgttaatatctaaaatatataagccactcttacaccttaacaggaaaagaaaaacccaaataactcagtttaaaaatgggcaaacaacctaaatagaccttttttccaaagaagacaatacaacaggtatatgaaaaggtgctcaacacccctaatcatcagagaagtgcaaatcaaaaccacaatgggatatcacctcacaactgttaggagggctattatcaaagagtcaaaagatatgtgtcgtcaaggatgttatacactgttgatgggaatgtaaatcagcagagtcattatggaaagcagtatggaggttcctcaaaatattaaaaatagaattaccatatggcccagcaatcccacttctgggtatatatccaaaggaattaaaattagaattaaaagagatatctgcatatctgcactcccatgtttactgcagcatttttcacaatagccaaaatatgaaaacaacctcattgttggtggatggatgaatagataaagaaaatgtggtgtgtctgtgtgtgtaatattattcagcctcaaaaaaggaaggaaatgctgccatttgtgacaacttggatgaacctggaggacattatgctaagtgaaataagccagacacagagggacaactacagcatgatctcacttatgtgtggaatctaaaaaagtcaaactcacagaaacagagaagagaagtatggttatcaagggatggaaggtaggggaaaggggatgatgttggtcaagaggtacaaacttttagttttccaagatgaataatttctggagatctaatttacagcatagtcaacaatagttaacagtactgtactctatacttgtaatttgctaagaggatatctcttaaatcaaatcttctcaacacacacacacacacatacacacacacaaaggtaactctgtagaggtaatgaatatgttaattagctttattgtggtgatcatttcatgatatatatgtatatcaaaacaagttgtataccttaaatatacctaattttaatatatcagtgatatttcaacaaggccatttttttaaagtctgtcttatatcctcctggaattagcaaaaacagggattaatatcagactcacacaaatgaagtccaggacctgtggctggaatgctcttgctggaagatacaataagacactgacttgtgagtgaaccacacgtctatcacatgcacaagaaagaactgcgctttccagtgtctacatgtggaggctataatgttgagtggcctgagatcgtattaaaatcaaagcatccaagaggaacacttggaaagaaaagaaggagcacaacagaggggtgagtggcaaaatcctagggactaagatgcccagacccagaaaaggcacatcctaaaagcctgcattgaatgggaagtcgaacgcacactatctcaggtaagagatttggcagaggctctgttatggattgaagtgtgtcctccagaacatttatatgtgaagtcctaacacccagtatctcagaatgtgacactatttggagatagggactttacagaggtaatcaagttaaaacaaaaacattaggtggccctgttccaatatgacgggtgtcctttaagaagaaaaaaatttggacacagacatatacagagagaatgccatgtgaataggaagacagtcatctataagccaaagacagaggcctagaacagagccttctcttgcagcccttggaaggaaccaactgccaacacattgatttctgacttatagcctccagaactgtgagacaaatttctgttgtttaaacactgagttggtgctactttgttgtggcagccttatccgactaatctgataaagccagccttatcagacttggccttggtctccaaaggccaacataataaatgtcaaatactgccataatctaaagtgaggcactaggacaccttgcgaagaaatggaaacatacaggatctgctggcattacttgtcacttcacttatatgtggaatctcaataagttgaactcatagaaagacaggagaagggtggttaccaggatgaagttaatgggaagatgctagtcaaagggtacaaactttcagttataacatgagtaagttctggagatctaatgtacagcatgatgattatagttaatgtattattctagattgggtttctacctgcttagaagtgaccgcaggacagttcgttaagagcagccagatgactatgggaacttcctgagattccttcccatacaaggaaagaacattctcaagccagttgtttcacataaaaagaaagttactttctttttgtttccatgaaggcagctcaacaacaacacagttgtggacacagtgaacgaatttctaactgaatatgctccagagaaatcggacagccaagaaattataatgaggacttcaggatggcactcctctctggaatgtttggtagccctaaggtaggagatacatagcaacttctcagctatgcacaatcctactgttctagcatttttcagtggatattgaaaatatgaaaaaataaaaaggcccccctgagaaaaccaactagtataaattcccctgcttaaaggaggatttcatacaggagatgatcctctgggaataaaaaggggctactaacccaaaaagagctgatggcagtcacacatgtggcagtctgcatgtaccctgacatctcacagaaagatgggataaagggacattgggttacacacacattatacctgccttgtcttcctgaatttctccccattcaacccccttttatccttttgttcccctttgtgctctttctctactttttcccatgtttcccatgttcttattaagctgagtgctatctatgaaaaaaaaatgcaatgatactcacaatgaagactggaccccaatcattcaaggatgctttcctagccatagctgagcagggagcatcctaataagatttatttccacatactcatctcccatatatgtggtttcctaaatgagatttgttctccaacgaccatggaacacatccagattctcctcctacccttttcactaccaactgcatttttctaaaagtgcattgtgaccttaggtgcctctggaattagaaggtaggttaaaaattccagccgggcacggtggctcatgcctgtaatcccagcactttgggaagccaaggcaggtggatcacctgaggtcgggagttcaagaccagcctgatcaacagggagaaaccccatctctactaaaaatacaaaaaaaaaattagctgggcatggtggcacatgcctgtaatcccagctactcaggaggctaaagcaggagaatcgcttgaacccaggaggcagaggttgcagtgagccgagatcgcgccattgcactccagcctgggcaacaagagcgaaattccgtctcaaaaaaaaaaaaaaaaaattctatcaagttcatttgtcaaaagcagctggggccttgaaaatccactctgtgcgggagctgaggcccaaggccaacatggagataaggccccctgagggctgccaaccacctcattgcaaacttgggattgcagttcctagcctaacaactggatacacaacatgtcatgatccaaaaggcagaaagaatacaaataggaggaaatgatttttgcaaaattacaggactacacatgtggatttactaggcgccagaaggtacagtgaattcgaaagccaacaatcaccaagtcctttcagagtacctttaaaaatacaaaacagtttcccagagaataaccattagtctaaatacccccacttaaagatataaagataatccaatataaaacttatctctaagaacaaccagaaggcttcaagtctagagagcagaaggaagtcaacctgtgacagggtctgcatacatgctgacatctcacagaatgacagaaagaaggaatactggcttacattcacttttgaaatacgtaaactagataactaaatgtatcctcagacccacaattaaggctgcattgaggcaagatggtgtgggtcagacaagttcctgaaagtctgtcttgaacaatattgaaagcaatacgcttttggatgtaagtattttggcacaggctccgaaggtcaaaacaataaatgtctaggaccccatatcctaagttgaggtaccatactatcttgccaaaaccctgagcaaaactgggtcagccgacattagtccatttccaaccttaaagatgtgaatattgaggtggaagaaggaggaaagaaatgttagagggaattgtcactgtggtaggcattttctcctgtgtcctgaataaaagccttcacttgctttccctaatctcataaacaaacatttaatgtaaatggaggaaatctgctgggaaaatgtcacatttagaatcgaaactgactttcttaagcctgtgctccactgcaagctgagcatcagctgtccattccgctaaggtttttttgtttggtttggtttttttattgtactttaagttctagggtacatgtgcacaatgtgcaggtttgttacaaatgtatatatgtgccatgttggtgtgctgcacacattacctcatcatttacattaggtatatctcctaatgctttccctcccccattcccccaccccacaacaggccccagtgtgtgatgttccccttcctgtgtccaagtgttctcattgttcaattcccacctatgagtgagaacatgtggtgtttggttttttgtccttgcgatagtttgctgagaatgatggtttccagcttcatccatgtccctacaaaggaaatgaactcatccttttttatggctgcatagtattccatggtgtatatatgccacattttcttaatccagtctaacatcgatggatatttcaggtggttccaagtctttgctattgtgaattgtgccgcaataaacatacgtgtgcatgtgcctttatagcagcatgatttatagtcctttgggtatatacccagtaatgggatggctgggtcaaatggtatttctagttctagatccctaaggaatcaccacactgtcttccacaatggttgaaatagtttacagtcccaccaacagggtaaaagtgttcctatttctccacgtcctctccagcacctgttgtttcctgactttttgaatgatcgccattctaactggtgtgagatggtatctctttgtggttttgatttgcatttctctgatggccagtgatgacgagcattttttcatgtgtctgttggccgcataaatgtcttcttttgagaagtgtttgttcatatcctttgcccacttgttgatggggttgtttgattttttcttgtaaatttgtttgagttctatgtagattctggatattagccctttgtcagatgagtagattgcaaacattttctcccattctgtaggttgcctgttcactctgatggtagtttcttttcctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggtttttggtctaacatttaagtctttaatccatcttgaattaatttttgtataaggtgtaaggaaggggtccagtttcagctttctccatatggctacccagttttcccaggaccatttattaaatagggaatcctttccccattgcttgtttttgtcaggtttgtcaaagatcagatggttgtacacgtgtggtgttatttctgagggctctgttctgttcaattggtctatatctctgttttggtaccagtaccatgctgttttggttactgtagccttgtagtatagtttgaagtcaggtagcgtgatgcctccagctttgttcttttggcttaggattgtcttggaaatacaggctcttttttggttccatatgaactttaaagtagttttttccaattctgtgaagaaagtcattggcagcttgatggggatagcattgaatctataaattaccttgggcagtatggccattttcacgatattgattcttcctatccatgagcatggaatgttcttccatttgtttgtattctcttttgtttcgtttagcagtggtttgtagttctccttgaagaggtccttcacatcccttgtaagttggattcctaggtattttattctttttgaagcaattgtgaatgggagttcactcatgatttggctttctgtttgtctgttattggtgtataagaatgcttgtgatttttgcacatttattttgtatcctgagactttgctgaagttttcaggttaaggagattttgggctgagacggtggtgttttctaaatatacaatcatgtcatctgcaaacagggacaatttgacttcctcttttcctagttgaataccctttatttctttctcctgcctgattgccctggccagaatttacaacactatgttgaataggagtggtgagagaggacatccctgtcttgtgccagttttcaaagggaatgcttccagtttttgcccattcagtatgatattggctgtggggttgtcatagatagctctcattattttgagatacatcctatcaatacctaatttattgagagtttttagcatgaaaggctgttgaattttgtcaaaggccttttctgcatctattgagataatcatgtggttttcgcctttggttctgtttatatgctggattacatttattgatttgcatatgttgaaccagccttgcatcccagggatgaagcccacttgatcatggtggataagctttttgatgtgctgctggatttggtttgccagtattttattgaggatttttgcatcaatgttcatcagggatatttatttaaaattctctttttttgttgtgtctctgccaggctttggtatcaggatgctgctggcctcataaaatgagttagggaggattccctctttttctattgattggaatagttacagaaggaatggtaccagctcctccttgtacctctggtagaattcggctgtgaatccgtctggtcctggactttttttggttggtaggctattaatcattgcctcaatttcagagcctgttattggtctattcagagattcaacttcttcctggtttagttttgggagggtgtatgtgtcgaataatttatccatttcttctagattttctagtttatttgcatagaggtgtttatagtattctctgatggtagtttgtatttctgtgggatcagtggtgatatcccctttatcattttttattgcatttatttgattcttctctcttttcttctttattagtcttgctagtggtctatcaattttgttgatcttttccaaaaaccagctcctggattcattgattttttgaagggtttttttgtgtctctatctccttcagtcctactctgatcttagttatttcttgccttctgctagcttttgaatgtgtttgctcttgcttctctagttcttttaattctgatgttagggtgtcaattttagatctttcctgctttctcttgtgggcatttagtgctataaatttccctctacacactgctttaaatgtgtcccagagattctggtatgttgtgtctttgttctccttggtttcaaagaacatctttatttctgcattcatttcgttatgtaccaagtagtcattcaggagcagatggagagttctgtagatgtctattaggtccacttggtgcagagctgagttcaattcctggatatccttgttaactttctgtctcattgatatgtctaatgttgacagtggggtggtaaagtctcccattattattgtgtgggagtctaagtctctttgtaggtctctaaggacttgctttatgaatctgggtgctcctgtattgggtgcatatatatttaagatagtttgctcttcttgttgaattgatccctttaccattatgtaatggccttctttgtctcttttgatctttgttggtttaaagtctgttttatcacagactaggattgcaacccctgactttttttgttttccatttgtttggtagatcttcctccatccctttattttgagcctatgtgtgtccgtgcacgtgagatgggtttcctgaatacagcacactgatgggtcttgactctttatccaatttgccagtctgtgtcttttaattggaacatttagcccatttacatttaaggttaatattgttatgtgtgaatttgatcctgtcattatgatgttagctggttattttgctcgttagttgatgcagtttcttcctagcatggaaggtctttacaatttggcatgtttttacagtggctggtatcagttgttcctttccatgttagtgcttccttcaggagctcttgtagggcaggcctggtgctgacaaagtctctcatcatttgcttttctgtaaaggattttatttctccttcacttatgaagattagtttggctggagatgaaattctgggttgaaaattcttttctttaagaatgttgaatgttggcccccactctcttctggcttgtagagtttctgctgagagatctgctgttagtctgatgggtttccctttgtgggtaacccgacctttctctctggctgcccttaacattttttccctcatttcaactttggtgaatctaacaattaagtgtcttggagttgctcttctcaaggagtatctttgtggcgttctctgtatttcctgaatttaaatgttggcctgccttgctaggttggggaagttctcctggataatatcctgcagagtgttttccaacttggttccattctccccgtcactttcaggtacaccaatcagacgtagatttggtcttttcacatagtcccatatttcttggaggctttgttcgtttctttttactcttttttctctaaacttctgttctcacttcatttcattcatttgatcttccagcactgataccctttcttccagttgatcaaattggctactgaagcttgtgcattcatcacgtagttctcgtgccatggttttcagctcaatcaggtcatttaaggacttctctgcactggttattctagttacccattcgtctaatcttttttcaaggtttttaacttctttgcgttgggttcgaactttctcctttagctcggagaagtttgatcgtctgaagccttcttctctcaactcgtcaaagtcattctctgtctagctttgttccgttgctggtgaggagctgcattcctttggagggggagaagtgctctgatttttagaactttcagcttttctgttctgttttttccccatctttgtggttttatctacctttggtcttcgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcagaggctgcagaacagcgaatattgctgaacagcaaatgtttctgcctgatctttcctctggaagcttcgtctcagaggggttcccggccatgtgaggtgtcagtctgcccctactggggggtgcctcccagttaggctactcgaaggtcagggacccacttgaggaggcagtctgtctgttcccagatctcaaactctgtgctaggagaatcaatactgtcttcaaagtggtcagacagggacatttaagtttgcagagatttctgctgccttttgtttcgctatgccctgcccccagaggtggggtctacagaggcaggcaggcctccttgagctgcagtgggctccacccagttcgagcttcccagcagctttgtttacctactcaaacctcagcaatggtgggcgcccctcccccagcctcgctgccgccttgcagttcaatctcagactgctgtgctagcaatgagcgaggctccgtgggcttgggaccctccaagccatccgtgggatataatctcctggtgtgccgtttgctaagactgttggaaaagcgcagtattagggtgggagtgacccgattttccaggtgccatctgtcaccccttgccttttctaggaaagggaattccctgaccccttgcgcttcctgcctcgcccagcttcggctgacactcggtgggctgcacccactttcctgcccccactgtccaatgagctccagtgagatgaacccagtacctcagctggaaatgcagaaatcacccgtcttctgtgtcgctcacgctgggagccgtagaatggagctgtttctattcagccatcttggaaccatcccctctgctaaggttttttgttgttgttttattttttatcaatatataacagttgtacatagtttgagggtacatgcgatattttgatatatgtatgtaatgtgtaatgacccattttctttgagaatttgagtcatttttcaatggcacctgctgtctggggatagtatgtgaattaaatagttcattgcagggagtactgtttgctgtaaaggttgcaccaatgtgtaactgcatgtggttggtgaatccaaatattaaaccagtccaactaacagttatttcaaagaattccacatctgctgtgtgcacaggattgacaaggccatacacagaaaagggatctactgcagcccatgaacagtggtaaccttgagaaagggtacagcgccaggtctgaactatctgcatgtgggatccagagatctttctactcgactagacagctggcaccctggacacatttgccagactcccttggtctcatatgctggaaacagtaagtcttaatttggggccagatcctgcattgcagatggactaccatgccttgttacatagtctatcaaggtagccattatctcaacatgggcaggacatgtctgatgagcttattaattccactaattttcatccccaaatggattttatccacaaggatttacatggggcataaataggaagtatgtattttatgcaattacctgattatagctgccacctctgaggctgagacttgatcatatagtcggccccctgccaggcattagtccacactgtcagcccatgggcaccttcccaggagtgattcaaaatataacaaggtgaattggggggccatttctaaggcaagcactgcagcctatatctaaaccaatacatcagaatttccttttcatgcacagaagcaagcaggttgtgtacagaatgtacaatttctgcagcctactacaccccatctgccttcaacttagtggatgcatccatgaacaagactcaggaacactcaggaacctggatgcaccaaagccaccaggaacaacaaggtggcacagtccctgcatctgacacagccacagctagagggtgactggacactttttcctacacctccaagatacctttactatctgatgtacttcttctctagaaatacccttttccctttaaaatgaatgtttcttagccaaaactcactttaatagcattctcatttgggattcatcccataataaagaattcagggtgtatcaagacctgctcttgtcttgttactctgttgatgtccaccaacaccaactaacaagccatcaaaagcctctaaagtgacatatatcaagtgatagtttcagacaaggaccacaaatgaatcccaaaatgtgctattacctttaacgaaagagccacgtcttttgctgtaagtttttgtctgcattaatagcagttactgacactttctttcaaaatgcctctgggtgacttgcctcagtggcaaggtgatctagacaacttgttggagagtttctaaggcaggctgttggtcaagctgaatgcctttcaagcaatcttatgtaatgagctgacagaatctctatgttatgtgcatgaaatatatccaatactaaacaagcttataatgttctgtgccaaatttggttttagggcagttttaagaccatcagtttttcctgaacaggctcaaagattatactctgggcaccaacccacatggttcaccagaactatagctaaatgactggctgttgattcttgtcaggattaatcttccagtgctggtcactcagatattggactattaaacacagacaatactgtgtccatagcccttacaatcagaataatgtcatcatttaaagacaccaggacagctccggttagatttcagtcttttgtaggtttcatcctatccactgatgagaaatcacaatgttttggttattatgaggcagcaggtgaacatatattataatctatgaagccaaaaagcctctgaaaaaataatgcaggggtgctgaagaaagcagtagcatgtccaccaccacaaaccaggccattctttctcaacaatgaactctgtgatcactttgatatctgcaagtggagcaaaaatgaggactgttgccatattgagcttgtgatatggtacagggaagcatcaaatactacagggttttttgatcaactaaaggaactcctttcaccagcccccaacatggaaccctatactgctttacttatgccccacggctgggttggagaaggctggcaggctctgggttacctattcgaccaactaccactactctatcatggcatttcccccactggaaatagcccttacaatcaagagaagaattacatatacttaacacaactctttccacaaaacactcagcagtatcaattataatatattgcctatgtattaacccaaaaaggcccacccgtaaactcacatcagtccatagtccaatctgacagctattcccacatccaaagtaaatttttgaccgtgccctttgggacttcttagagccaaagtgacttgtgtccccatgcccataaggactgaaaaggcttgactactttaagtcctcaacccttgactacatcaagttcccaacataccttgattggtgcataaagcctccagttccatttagagaaggaagggccacatcctctaccctagacttgtatgttcttaaaaggagaaagatctgggccaggtgcggtggctcttgcttgtaatcccagcactttgggaggccaaagtgggtggatcacctgaggtcaggagttcgagaccagcctgtttcaacatggtgaaacatcagctctactaaaaatacaaaaattagctgggcgtggtagctcacgcctgtaataccagctactcaggaggctgaggcaggagaattgcttgaacccaggaggtggagggtgcagtgagccgagatcgggccattgcactccatcctgggcaacaagagcaaaactctgtctcaaaaaaaaaaaaaaacaggagaaagatctaggtagaaaggtggtataaaatgtactaaatgtgataaatgtcagtctgaagagtacatatctcagcaagggaggataagcctctcagtcctcctgtgattagcaatgtggtcatggccagactggcttggaacatagggtggatcatagatgatggggtgatcttcaccccttgtcctccagcacaactgacaggactccctcatctgctaaccaaggagcccaacacatattgcctcactgggcatttgcccatcctcaatatcacttctttcctactgactgtaggagcggacctcagtacatttctgtataatagactgtccctgccaccactttatcaatgaggtctgctactgctcctcaagtcctgttccatacttgtccaatcaacctgtgggatctcacttgtattttttccaaaagggcactatgaccttatcagcctccaggaaaagggaattaaaaatatgatggaaccaatctgtgaaaaaccaggtgtggcagagccccatgtagttttccctcttttactttaaaataaacaggccaacttttgcagccattttgtagcaataactgttctctcaggaacacagaatactttatttggtgaaagacaatagttgttctttgactacaaatgggattcagtgagggaaaccacttacattatttcaagtatcataactggtaggtaagccccggattttgttggggatcttaagtttcccttgctggtgtgcatccgaggccatagggttgacaccttcagtttgccagttgagagattataacacagtgaaagcattaggcataagaggaatttttcaggccgggcacggtggctcacgcctgtaatcccaccactttggaaggacgaggtgggtggatcacaaggtcaagagtttgagaacagtctggccaacatggtgaaatcctgtctctactaaaaatacaaaaattagctgggcatggtggtgcatgcctatattcccagctacacgggatgctgaggcaggagagttgcttgaacccaggaggcagaggttgcagtgagccaagatcacgtcaccgcactccagcctgggtgacagagcaatactccatctcaaaaaaataaataataataatttttcaccgataagatttgagcattcacaattcaacatataacacatttcaaaattaattacacattagtaaacagtgcatacaatgaatcagctcacaggcctctcaatgataagatcacttttaacttttttatcttttcgctacaagttctaccagctgcattcagacaatttttatagaaacaaagactataaataatttttacacagacactacaataccggcttccaggagaccatctactctccttggctggaagcccagaaaataaagaggtgcgagacacaccacgagaacaactggcaccagtaagcacgagtttgtacttgctttcagccatcctctggggttacaaaaaaggtacctttaacaataattaggcaccaattaaacagatgatttcaatcttacctcttgctgcctaaccttccaaactttttcaacaggtgacatacactattggaccccaaagaaactatcttatcttccccctaacttggcccacacacagcaggcccatttacccctaccttggcccactgttggacagtgggaggacccctacactcccactcacccatcgtgtagacaaggattccagggagccttgatctctcctaatccaccctatctgtgttacacagtcataagaatctcatctcattcaatggcttgaccacagtaagtccagtgccatggatccctggtgccttatccatcctaacatggaatttacaatctcctagtggaggaactttattgcccctcttgcctaccacttaggtgagaagatgtgtcttagaaaccaacctaactagtgtgctgtcttgtctaataaaagggccaactttttcagccacacattccagaccagatatgtcatctcatgcacagagacatgcaaggccaaggacaaggcccaaattattattccactaaaaactctaaaaacacacttttacagccggctgcagtggctcacgcctgtaatcccagtactttgggaggccaaggcgggtgaatcacttgaggtcaggagtttaagaccagcctggacaacatggtaaaaccccatctctactaaaaatacaaaaactagccaggtgtagtggcacacatctgtagtcccaactacttgggaggctgaggcaggaggatcacctgagcctgggaggtggagattgcagtgaacaacgattgtgccactgcactccagtctgggtgacagatcgagaccctgtctcaaaaaaaaaaaaaaaaaaagagtggtggtcaaggggagaggagatgaagacaggaaaggcaaaaagagttactatatcctcacgcctgtaatcccagcactttgggaggccgaggcagacagatcacgaggtcaggagatcgagactacggtgaaaccccgtctctaccaaaaatacaaaaataagccgggcgtggtggcgggcgcctgtagtcccagctactcaggaggctgaggcaggagaatggctttaacccgggaggcggagcttgcagtgagccaagatcgcgccactgcactccagcctgggcgacagagtgagactccatctcaaaaaaaaaaaaaaaaaaaaaaaaaaaaagagttactatatccatcctgttacatatatatacacatcactgacaggatgacaaaacccatgaatgctccagttaagagttcatggaaatgggctgggtgcagtggctcactcctataatcccagcactttgggaagccaaggtgagaggatagcttgaggccaaaagttcaagaccagcctgagcaacatagtgacaccttgcctctacaaaaaaataaaaataaaaataaaaaaattactaaatataaataaataaaaatagagtaggctgaaacgcctcagtctttaggagcatagggttttgattgatatagtacattgggcttctaactggttagaagtgacaacaggatggttggttatttaaaagtcaacagatgtctatgggatcttccagagatttcctcctagacatgggaaaaaccgatccccaaggcagtttccttctctttattaccacctctttattaccatctctttattaccatcaaaggcttctcaacaaactgctgatgaagacatgttctggaagaaagtccaccgtttagaaaagggtctaccttccctctaacaattgtgggatggcaatatcaaaaatgtatctcaaagaagaaaccattcctagaaaagcccggacaaatgtgaacagataacatctgagacaggagatgataatgtctcacttcacagctatgatgctcaaatgagagcatcccatttcagcctacagggtctcgcctgtatttttccaatagaacattatggccttagcagcctccaggaggaaggagttaaaatcccatggagtcaaaagctctggaccagtgaccacccagtccctgtgaaagctcatcagctcaggccgggggcctacataaaaacaaaccactcaaggtgcttctactgcctaacacacaaacttgggctcaggctttctggactggcatggagccagtccatgccacgcatagagcctagaggacggacatgttgctatatgaatagcaaaatgaatataacacgagaaactggtgatcaccaaaatgaagcgctacctgtactgatcagtcacattgcctagattcatgaagctgtagtgaaatcaatatccaacaaataccaagacgtttctaagtgagtatttaagtttacaaaacaggctccctgagaaaacccacaagactaaacacccaggcttaaaagtgtgtggacgatatcacactggagattgtccagtatgaaaactctctgagaataacgaggtggatttgaatccagagacacctaaagacagtcacatatatgggggatctgcatataaataatgctgctacgaacatttgagagtaagtttccatgtgaacctatgttcaattctattgtgtatttacctaggactggaatagaattgaacatggaaacttactctcaaatgttcacagcagcatgattccatctataagaaatatccacaataggcaaatccatagagtcagatagtagattaatggttgtcaggtaacacgaagtagggagaaccgacagtaactgctaagaggtatggggtatcattttgggttaatggaaatgttctggaatgagatcgtggtaattgtcgaataataatgaataaactaaaaatcactgaactatacactttaaaatagcaaaatgtatgtatattaattatatttccccaaaactgcaaaattaaacaataacaaacatttctcaaactcacggtttgtgtagatcatgaattctggaatggcggagctgggaggttctggcccagtgcatctcgtgaggctgtagtcaagatgtcagctggggctgcaacatcaaaattgactgcaggtggaaggtctactttcaaggagatacagtcacaaggctggcaaggtggtgctggtagttaatgagagatctgtttcttcccacgtgggcctctccaaaggctgtttgtatgtcctcacaacctggtagatgacttcttctagaatgagagaggaacaaatattgcttccccattacctcaagcaaatgacaaaaaacttcagaaagcttggcttttatctcctgcaggttaaggattgcaggaaatagtatttgactcatacaagtaaagtctagaggctggggctagagcagttcctggcagaaggaacaataaaaatgggatgcttggacataacctgaactaccagcaaatgcagaaaaatctgtgtttccaaggaacaaatatggatcctgaaggggtggcctgcccctccacacctgtgggtgtttctcgtcgggtgggatgagagactgagaaaagagacacagagacaaactatagagaaagaaaagtgagcccaggggaccggcactcagcataccgaggacccacgccggcaccagtctctgagttccctcggtatttattgatcattatctctaccatttcagagagggggatgtggcagcacaatagagtaatagtggggagagggtgagcaggaaaacatgtgaacaaatgtctctgcatcataaacaaggttaaagaaaaaagtgctgtgcttttgatgtgcatatacataaacagcagtattgcctccagcatgtctcacctccagccctaaggctgttttctcctatcacagtagatggaatatacaatggggttttacaccgaggcattccattgcccagggacgagcaggagacagatgccttcctcttatctcaacagcaaagaggccttcctcttttactaatcctcctcagcacagaccctttacgggtgtcgggctgggggacggtcaggtctttcccttcccacgaggccacatttcagactatcacatggggagaaaccttggacaatacctggttttcctaggtagaggtccctgcggccttccgtactgttttgtgtccctgggtacttgagagtagggagtggtggtgacttttaacaagcatgctgccttcaagcatttgtttaacaaagcacatcctgcatagccctaaatccatttaaccctgagttgacacagcacaggtttctgtgagcacagggttgggggtagggttacagattaacagcatctcaaggcagaagaatttttcttagtacagaacaaaatggagtctcttacgtctacttctttctacatagacacagtaccagtctgatctctctctcttttccccacaggatcccacaaaagggagtggcctgagattaccttaaaaggaaaaatagctaagtgggccacccactggggtggaaggaccccaacacagggatgggctacaaaaggcctagggactgaggggaagcctaagtggccagaggaaagacactggatgtggcagggtcatgtactctgaggtccctcaaggaacctgcaaatatccccatttactgtgtcagacaaggatttcctccatatcaccaagccctaaggctatattgcaactttgcgaaccatgcaagggtatgcccttctcccacaagcctgctactttccgggcccccgctgtagatcagaaacagtgtgtggtgaaatcaagtttacatatgaacatttacgtgaccattgactaatatttgtgagcatcagtggaattttagcttgataatagcaggaacatgtctattttgttactgctgcctcccagtgacagtgtctggcacatagtaagtgctcaaaaactattcctgatccctacctcacatgttacacaaaattaactcaaatggaccaaatacctaaatataaaaacgataactataaaactcttagaagaagaagagaggtttttatcttcatgaccttagattaagcaatggcttcttaaaaatggcaccaaacatacaagcaaccaaaaaacagagacaacttgtacttcaacaaaattaaactgttttacatcaaagaccctagcaagaaagttaaaagacaatccacagaataggagaaaatatttgtaaatcatacatctgataaaggtttagtatccagaatataaaaagaatttgtataactcaatgacaaaaggaaaataacccaattattacataggcaaaagatttaagtggacatttctccaaagatgatatacaaatggccaaagaacacataaaaagatgctcaacatcattagtcatttaagaaatgcaaatcaaaaccacaaagagatacaatctcacaccattaggatgactataaccaaaaaaaaaaaaaaatgggcaataacaagtgttgaagaggctgtagagaaattggaaccctcaaacattgctggtgtgaatgaaaaatggtgcagctgctgtggaaaacgctttggcaggtcttcaaaaagttaaacatagagttaccatatggtccaacaattccactctaggtatatacccaacagaactaaaactacatgttaacacaaaaacttgtatgagaatgttcatagcatcattgttcaaaatagcctaaaagtgtaagcaacacaaatatccatcaatttatcaatggataaacaaaattggtatatcaacaatggaatattattaagccataaaaagcaatgaagtaccaatacacactacaacatggataaactttgaaaacattaagaagccaggcacaaacggacaaatattgtatgatcttacttatatggggtgtctagaagtattcaaattcatggagacagaaagtagaatattggtttccagtgcatagggggaaagggagacagagatttattgctaattggttacagtttcagtttcggaagatgaaaaaattccggaggatgtggtgatgagtgcacaacagtgtgaatgtactttatgtcactgaactgcaaaaatggtaaaaatacttaaaaatggttaaaatggtaaattttacattatgtatattttaccacaataaaaaaggaatgaagtactaacatgatacaacttggatgaatcttgaaaacattatgcttaagtaaaagaagacacaaatgattccatttaaataaaatgtccagaataagcaaatctagagagagaaaaagtaaattagctgttgtatggagggatgttgcttgttggataggaggaagggagaaattgagagtgattaataggtaggaggcttcttttaggggtgtatatataagtgttctggaatcaaatagtggtgagcacaaagcacagcattgtgactatactaacaaccactttatattttattcttaaaaatgaaaaaatcatgttttgtgaattttgtctcaatttaaaaattgggcagatagtcttcccccagaatgagtaatctaagcacaagacagacagaaagtatctttttatgacgcagcctcagaagcaacaaagcattacttctgccatattcatcagaagtgagtacctaagtctggcccacattcaaagtgaggcttaacatttaccctatcatttcagtttcacaacatagggaaactattactgtcttccatgtgcagataaacacactgaggctcagagaggttgaataaacttaccaaggccacaaggccaatagatggcagagctcctatttgaatttaaaaatacctgactccacaacctgtgcttttaactaccatcagtggtggttcttaatttgcccatttgtgaaacctatttgtgcccatttgtgaaaccaaaaatgcttggggcctcccaaaaacctattgaaacatcatttctaagccaggcacggtggctcatgcctgtaatcccagcactttgggaggccgaggcgggcggatcacgaggtcaggagttcgagaccagcctggccagcacagtgaaaccccatctctactaaaaaaatacaaaaaattagccaggcatggtggtgtgtgcctgtaatcccacctactcgggagaccgaggtaggagaattgcttgaacccggtaggcggaggttgcagcaagctgagatcatgccactacactccagcctgggtaacacagcgagactccatctcaaaaaaaagaaggaaacatcacttctgggcctgtaatcacagcacttgaatggttttgttggttggttggttggttttgtttttttgtttgtttgagacggagtctcactctgttgcccaggctggagtgcagtgacgcaatcttggctcactgtaatctccgccttccaggctccatcaattctcctgcctcagcctcctgagtagctgggattacaggtgtgcaccaccacgcccggctaatttttgtatttttagtagagaccgggtttcaccatgttggtcagggtggtcttgaactcctgacctctagtgatccgcctttcttggcctcccacagtgttaggattacaggcgtgagccaccgcgcccagacagaatgtttttaagctccccaagtgtttctgaggtgcatcctggatttggaacctgccccctgtctctgatggttttgtattattaatatgggctactgactccagctggatggtaagtatcttgagggcagggcccccacctcaagcttccttgttgatgtcactgtgatatcacaatgtctgcacaaatatcattggatgaaaggattcagagcaactgccacccagaatgtcagttgccagggagctccaacagaactgagggacgaacagtaggtgcctgagagctggccgatctggtcactctctccagtgggccacaggggcccacttggtgggcagtctctgctgccagctagggcatctcagctcagcccagagcaaagacgtgtagggacataacgctttcctcaagcttcctttcccaggtccaaacttagaggcccagttttgggcctagaattcactgaggtttgtggctgtttgtccaacagtcaccatggatcaccgaagccgactacggggcacaggcctgaaccgaatccctgggactcagtcccgagccccccgagtcccactccccttccacgtgcaacaggaggccagggaaggagaagactgggagcgagagccacctcgtcagaggcctcctatctatgagccaccagaaagtgaagagctgccagataatgttatgggtaaggacacaccctccctcagcagaaggaggctggcatcatctttttcatcctttacctccaggaagcaggggccgggaggcagaaagcagagtatacagtgggcagaactagggtgagggatgagtttggaaaggggaaattttctatctgccacaaaagattgtttcacaaggagtaaggataaaatatgtgaaagcaacttgaaactgaggctgtctgcaatattaggtgttatttataaaatcaggtgtttgcaatgtcagttgcttactgtgggccaggttctttgggaaacaaagacctattacacattgatttcagccccagacagcccacagtctagtagaggaaagacaaacttaggatggtttctgcaggattcagaaagataacaggtgcttacagaaaacaaacttaacatgttctcacttaattgtgggagctaaaaattaaaacaattgaactcatagagatagagagtagaagaatggttactagaggctgggaagggtagtggggggctggggaggaaagtggggatggttagtgggtacagaaatatagaatgaataagacctagtatttgatagcacaacagggtgactatagtcaataacaatttaattgtataccctaaaataactaaaagagtataattggattgtttgtaacacaaatgataaatgcttgaggtgatggataacccatttgccatgatgtgattgttacacactgtgtgcctgaatcaaaatatcccatataccccataaatatatatatatacatatacatatatatatacatatacctactatgtagccacaaaaaattttttttaatttaaaaagaaagataacaagcacttgcaggaggacagagggcaccctgggatcatacaggctcatgcctgtaatcccagcactttgggaggccaaggtgggcggatcacaattagctgggcatggtggcgcgcacctgtaatcccagctactcggcaggccgaggcaggagaattacttgaacctgggaggtggaggttgcagtgagccgagattgccactgcactccagcctgtgcgacagagcgagactctgtctaaaaaaaaaaaaaaaaaaaaaaacaacctaacacagggttaagttgcaacattgcctgtttgccccatagttcctttccagctggaagagaagaaatggtctagggatatggcttttcaggttagacttttcttctccaagttttctggggacctgaaaagggctccgacttgagagaggagtcatggctgttcacaaagatcactgcaaggaaaagaataagaaatgtctgttagagggataaaacgcgagctattcagaggcagaaaggtcagtttccctttgaggggcgggggtggcgtgggatgaggaggctttttgggagagatgggcgtggaaggatgtctaacaagtgctggcggcgagggtcgttggcacttcaatggtgggaagacagccatgggcgaagctttgtggaagaaataggtgtgaaggatgagaaggcctacaacagtgctgagggcgcgaggccagtcacctgcgaagttttgtgtacaagatgggcccagaaggatgaacagggtctaaaacagtgctgagggtgggagtgcagaagatcggtcacaagtgacgacacaaggtggtcttagtccagttggtggacgctcggtggcctgggcctgcccccagtgcgcagacgcacacggcaggttgcagcggcaagcggggcggtgcccacggcggggagatgggtggggagggcagggaaaaggccaggggttgggtgatggggtaattgtcagaaaaaggaacaacactgctgggagagttttctggtaacttttcaagtcttcatttaaattaaaaaaaaaaaaagctgtctttgaaacaatagattaggtcactaaaaactgcctgtacgcccttgcatgctggaggaaagtaaatggttagacctaccctccctaagtttttccaggacttaaaagagctgcaagtagtgcagatcatggccccgttcacacaaatcacttcaagaaaaaaaattagtaaatgtctattagatcttgaaacttattcctgtctatctggaacttggtaacctctgaccaacaactaactccccattccttccctctcgcctcgccttccctacttcccaacctctggtaagcagcagggtaaatacagtcaataataatgtatatttcaaaatgaataagagtaaatttgaaatgtctcaccataaaagtcataggtaaacaaggcgatggataagttaatgtgatgtaatcatcccacattggatacatatttcaaaaaatcacattgcatcccacgaatgtatacaattatgatttgtcaagtaaatataatttttaaaaacgttaagtgactttttaaaaagcttattagaagtataaaatgcaagccattcacaagcatataggttagattccgcttgtgaggggcttgtgtgcagtggtgaggctttgtggaagagatggacgtggaaagatgtctaaaacagcgcggaggtcaggagaccttgtcgctgccttcacagagttgggcaacgctcccggtcctggtcagccgcgggacgcaggcgcaaatgcaggcttgggatgggggaggtgcggccggcgcccacgtggcggggcggggagcagatagggggggtagggggaggagctggtctcgcgaggccgcgccccggttcgcgcgggcgtcgtgcacgcggttgtagctgcccggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagagtaggtggtgtcccgccaaagggtgggaggggagattccggagacacgtgtaccccggttacacccccggaatctgggcttgggcggcaccccctgggctgcctccgggccctgggcgggcctggttctcacctaggagggcggggaggggaataaaggggagttctagctgtgaagaaaggtatggtttccactgatcagattttagaagaggtagtggttaccccaaaagccgcagctgagggaaagtgggtggccctagtcccgagtttgcatcgaggatgttgggcaaactgaaacagttcctgaaacatctcaaagtgccttcagcacatcctgtctttttcaggtactatttcagcgaaggaagacattgataggttgaataatgattcacaaaaagtttgattaaacagaaaagttgctaaacacagtgctcgggaggtcaaacatttcatttttctttcttcctttttgtttgcatcttacaaagattattactgaaagccaccttccccaaagcctgtgtagttaatggatattccttatgtttctcagacatgaagaacctattacagagtgtacttttgagggaaatgggggaaaaggttagaagtatgcatttgggttgatgataaacctcgtggcaaatttgtgtcctgccaatttggtttttgattatttgcatttctgtccagtgtacaaagctaatggccactttcaggaatgacacgtcagacgaagtagatactgtgaaagttgtagcctgctacatctggatgttaaaattaaccaaaagtgaacagtggctatagataaaggctgtctcttgcttgctattcagtaacctgcttttcctgcagatcatttgacattctgtaggtgtgtagttggtttttatggttcagttacagcatgttccatgccagtattcagtgaaaaaagtaatgcttcaaattctgaatccctagagttaaatggaatgttgttatgacttaggatgggttggttgggagtgataaatgagaaaaactgttttgtcctcttaaacatttacagttcttacttgctgaaagtaagtactttcagttaaccactttgggactttttttttttttttatttgagatgaagtcttgctctgtcacccaggcacccaggctggagtgcggtcgcgcgatctcggctcactgcaacctccgccgcccgggttcaagcgattcttctgcctcagcctcccaggtagctgggactacaggcgcgcaccaccacacccggctattttttgtatttttagtagagacggggtttcactatattggccaggctggtctggaactcctgacctcatgatccgcctgccttggcctcccaaagtgctgagattacaggcgtgagccacggtgcccagcctactttgagatttttaacaaaaccagtcttaaattttaaaatcagtatttccaagtcccactggttttacttgcctgggaaagtattttaaatatgtcagccagttaagtgtttacttacattacatatattttccataggaaacaaatctacttcaaagctttccctttaccagcaaaacttaacattttagttgtttactacatttctctgtcacatgtaggcttatctataattaaagatacaaagacttttgttagtaaagactattatggagccattaaggccatattttcaaataatttttagtaatatcaaaaactgttcataattaatttactgtttcctttaaggagaaaaaaaaggcgggatgcaacacgtggcaaatttgtgtttaaaaaagaacggaaaggccaggtgtggtggctcacgtctataatttcagcactttgggaggccgaggccatccgatcacctgaggtcgggagttcgagaccagactggccagcatggtgaaaccctgtgtctactaaaaatacaaaaattagccgggtgtgatggcgcatacctgtaatcccagctactgggcaggctgaggcaagagaatcccttgaacccgggaggcggaagttgcagtgagcccagatcacaccactgcactccagcctgggcgacagactgagactcttgtctcaaaaaaaaaaaaagtaaataactaaaattaaaaaaaataagactagaaagacagacatcagaatgttaacagtagttgatgggagttatggagagagaggatttaagtattctttgtacttctctgcatttaccagaatctttatgttaattacataatttatattcaagacaatttttgtttttttaataaatgcaagggattgctttgggaattccatttatagatcttagcaaagtaactaccattcttaaccaaatatttccaaaatcaattttcagaacaaaatttatttttcaaatatggttttcccagtatgctaaaatcattaaggcgtgtcattgtaatagatcattacaattattataacctctcacttgagtagcattttaagtaatttatttaaagtatatataattgaatactcttctgctgtctatttctccctcctggcctttacctaatcagatcaggattatatatatgaggtaggatgctggctcaagataagtaatcatatgttatatattaatttttaagagaaattcatgttgtttgtctctattttggagtgaccataaatggtggctgttacagagaagtataagccttactttctaggacccttagccaaacttagaagcaagcattgacttcagtgtttgtaaggggtctgaaagtataagtgctatctgaatgtgttaacagagcatgaaggtgcattagtatctaagtgtgttggctaaaattactgtacgcccttacaagagagcagcatgaactgttcagtttccattgggtcacttgaaacctgttcaagggagtcttctttcaaagccctctaggaaaatgatcccatggtctgggattttacacttctggcctgacatatttgtacattccctcctcattttgtgtagcctcatctgcagcaggtcctccatgtgtatgtcagaagctggacaaactagtacatctggaagactgccattagagaaaggaaaatctaattatttgaaatgtaggaagttgacaacttgaagcgggactatagtgaagtatccaggagggtttagtgcagggtagaatttaaggggtctgtgagcatgaataggggaaaaaagtatttattttcactaatccccatctgaaatttagtgtttccttctattatgaatgtcagcaacaaactacactatcttcagcagcacttgcttgtacctttcaccaatagaatcacttattttcttgctacatatggttatcgcaggtatcctgaaacaccattttcactcatcattatcttacgtagttgtcagattacaactagatcttgcagttttgaagtgttatagagcacatgtattatgatatcaccaattttttttaatatttttataattgcatttaaatacaattggtttcttttgtaattctatgtattttcctttttgcattcaataacactcttttaagaagtctgtaagcttcaccagactgccaaagagatctaaaggtagccctgatttttagtgattttctaaagatgtccttctaccattccaccaactttctcagtgttacagaacatcatgtattttattttcttagtttccaagccagcgccctactgggaaggaacagctgtgatcgatggagaatttaaggagctgaagttaactgattatcgtgggaaatacttggttttcttcttctacccacttgatttgtaagtaatacatgtaaatagctagtaaaatctcagtctttatcaattatttttcaggagtatcaaacaaattattttgttcagctcttggtttttaaaaaggcaagctgaagtaaagaaatgtatttaaaaaggtaacatctaccatatatttcagagtcataacacaccgacctcaatacttatgtctacatgattatgttataatggaataattagaggaaagctacaatatattcattaagctatacctactaaggcaagaaaatggactgataatatattagaaagcatttaatagcaagacctatgccataattctttttactgtatctctcttgattagaaaattaattctgtaatcccagcactttgggaggccaaggcaggtggattacaaggtcaagagatcgagaccatcctggccaacatggtaaaaccccatctctactaaaaatgcaaaaattagctgggcgtggtggtacgcgcctgtagtcccagctactcgggaggctgaggcaggagaattgcttgaaccctggaggcggaggttgcagtaagctgagatagtgccactgcactccagcctggcgacagcgagactccatctcaaaaagaaaagaaaaagaaaattaagccattttctctagtgataccatgtaactgtggtttttccatttttattctttgctgcatctgttgcttttctgggatttgaacattttgctgaaaatattatatactgcttaaggaataaggaataacacctgtgtatatgttatggttattgtggggtttctcgtctttttttaactctgtgacagtgagcgtttttgtatatggtcagaaagttgactaaaagtaaatacccttacagctttattcacgttgaggatttaattttattttacaaaacactattttgagtgtttttcaaaattcatgaaagtgagaagagaccaaaaagagttatgtcaatttttatcttttattctcttggaacttactttttggttacaacaaataactagaagtttcctcctctatctttgccactgtgcctttttccattaggactaatctggaactacatagatcaaatttaaacttgcagggagggtatacttaagctcattgctataggttgtttctaggccagggattaacaaattttttctgctggatttggcctattgacctatttgccaacccctgctctaagccacaaaggaagaattctcatgaaaattattacattgagactaaagttatgagtctgcataatatataatcttttaaattataagaacttgcttctttctaatcaactcatattgtgacttgatttttttaagtatagcttaatttctaatagaaaccagaagtagaaatttcagtagacataaaaaatgacaggccttctaaattcatgttgttataaaaccagaaggttaacatgtatgttaaatatatacgactaacaccctgaatttggaagttagtctaatgtagcagaaaaatatgttctgtgtttctccattgttattcataactccataatgggtaagagatagttaattggagcatgttgttagcaatggtcttctgggacaaggagctaagatagcctcttcctgttttcatgtaatgctggactgtgcctggttagagaaggaagaattctggggcatttgccacagtctacaaggaggaaagttacaaacgtaacccttcagtttcctgccaaaactttttctgtcttcactaagaagttggtcaaatgtatctctaggtagcattccttgaaataagaagaaaggcagaggctgggtgcagtggctcacgcctgtaatcccagcactttgggaggccaacatgggcggatcacctgaggtcaggagttctagaccagcctggccaacaaggtgaaaccccgtctctactgaaaatacaaacaaaattacccgggcgtggtggtgggcgtttgtagtcccagttactcagcaggctgaggcaggagaattgcttgaacccgggaggcggaggttgcagtgagctgagatcgcgccactgcactccagcctgggtgacagagtgagaccctgccacaaaaaaaaaaaaaaaggaaggctgaggctgaccattcctaccctttagaaaatattaaaaatacattttatagcccaggtttccagggacatcatccgagattagaactgtctacttggacatgacagtgctgtacctgaatacctgaaacatgttaaaatcctgtattggtatctggtaggaacttgtgccctaactaagtctatgtttttcaaactttcttgaccatgtctcacagtaggaaatacatttttcgttgtcagccagtacacaggcacatatatatacggtaacattccatctggatgcaccagcacagccatgctccttaaaatactgaaaaaccctcatatcatgtggtaaatagccacttccctttcctcaccaactagttagtcctcctgcctgatccctttcagaaacctccagaactaaagccagctttgagttaagattgttaaatattttgaatatcatcactgttgaagacaaacatatatatttgtatatataaatatgtgtttcataatttacccttagtatgtatgatagagtctcctgttttctattcgatttcactttttaaaaatattttttagaactcagttaatttaaggagtccctaccacggtttgaaaaaatgccaccctagtaatattctgtaaacatggcctgacaacatgagggtattaaggtataaaatccctggctgcacaggactggtagacaaggtggaagaggaccttatcaagaaaggaggggtgggggtactggaaaacattgcctcctctccaaaatacacatagatgcatctaattcatagggttggtataggaatattaaaaaaaaaatagtgaaatgacataaaatttgtatagatcctttgaaagctataaaatactatataaataaaaggtattattaaataaaagtaataaaatgaggggtggctattgctataagggagaagggaacattggttgactactgatctattaagttgtaataagaaagtttattgagatgtagttgggaactctgtaatatgtttctgtcttaaatatttgattaaatgacagtcttttagactactccattttgaaaaggttcaaatataaaattgttcttaatgtgcatttttattattaaaggtatttgtaaaaattgtcatttgaaagtttaggtatatgcttatttggagaatactgaatatttttttttttttacctttcagcacatttgtgtgtccaactgaaattatcgcttttggcgacagacttgaagaattcagatctataaatactgaagtggtagcatgctctgttgattcacagtttacccatttggcctggtcagtatcttacacttatattcgtagaaaaaaaagaatggatttactcttaaagcatggacagataactcttgatatgatataagaatatagtcatttatcagacaattcaggaatagctttatctaagagtaatacatgtaactacacattttccaggttaaaaaaagagagaagagtaatataatcagctgctataataaaaatgcttaaggattttataggacatttcaaaataaggggaaaagttaaatgcaatagatgtgatttctatagcgaaaaccactgaattatatgcttatgataaattgggttaccataatctggaggaaaaaaatctttaaaatatgccatttctctgttacacagttatatagtcaaactcagcttttacaattttgaagaaacaatactttttaaaaatgaattttaaaaaatgtttaaaaattcattaatcataaaaagatgttttacctaaattcgttataaagaattgcaaattaaaatgacgagatgccaattttccctgtctggttggccaagatttaaaagattgaaaaaatgtatccactgtggacaaaaattgaagaaacggcactcacacacagctgtttagcatttctggagagcagttgggcaacatgtctcaaaattggaaatttacatgttaatatgagtttttatagtgtccacagtcttgtgcagaaaactttgtgcacaataaagaccattcagaattgggctgggcacagtggctcatgcctctaatcccagcactttgggaggccgaggcaggcagatcacctgaggtcgggagttcgagaccagcctgaccaacatggagaaaccccgtctctactaaaaatacaaaattagccaggcgtggtagcaggtgcctgtaatcccagcaactcaggaggctgaggcaggagaatcacttgaacccaggaggtggaggttgcagtgagccgaggtcacgccattgcactccagcctgggcaactgggcaatgagagtgaaactccatctcaaaaaaaaaaaaaaaaaaaaaaaaaaaaaaagattcagaactattggttttaaaacataatattcaatttattaaagttacaaatttgaaacacaagcttttctcatttataatctgtgtgtgtataacaaattttcattgcttggtgagctacaatttaattaattacatttccctaagaaattaattcccataagtatttttaaatgcagttatatatttaatatatttgaattccttaagtatctcaattttcagacaaaccttcccaaatacttaagtagttctaatatgccaaattctcttaaacattataaataacttaacatataaatatgtactgattatttcttaatgtaaaaatattaaaatagcctggcatggtggctcacgcctataatcccagcactttgggaggtcaaagcaggagaatcatttcaacccaggagttcaagaccagcctgggcaacatagtgagaccccatctatacaaaaaataaaaaaaattagccaggtctggtggtgcatgcctgtggtcccagctactcgggagcctgagatggaaggatgacctgagcctaggtggtcgaggctgtagtgagccaagatcataccactgcacttcagcctgggcaatagagtgagatcctgtctcaaaaaaaaaaaaaaaattaaaatataggcttaatttgcttcatcatttcctttaaaaaaagaaagacagggtcttactatgttgcccaggctggagtgcagtggcacaatcaatcatagctccctgcagccttgaactcctgggctccaacaatccttctacctccccaaatagttgggactgcaagcttgcaccaccatacctattttaatttttatttttgtagagatggagtcttgccatgttgcccgggctgtgcttcatcacttctgtagtaattataaatcttccgaggattaaaatgcatatccactaaggaaaaagttatggcatcccaaataatttgggattgctttcccaaggaaatttggggatacattctcagcctgatagggttcacatcaaccagaaatttctacttgggtgtcagaactggggctccagatatctagagcaatgtcgttttgttttctatctgctgtgtcagtaccctcctgttagagcatcagcccatgtctcctggtttcaagttacagaatacagattgagcgtccctaacctgaaatccacagtgttccaaaattcaaaatttgagtgctgacatgatgctcaaaggaaatgcttagtgaagcatttcagagttcagattagggatgttcaaccagtaagtatgcagatataccaaaatcggaaaaaatcctaaatccaaaacacttctggtcccaagcacttccgataagggatactcaacctgtagtgaagactgaggcatctgatattataactcacttccttcactgcttcaagtggactttgcatttgtctctcagaatattaaaatgtcatccatttgtatcctgcctgtctgttcaaggctttatcttatgatcacactactaaggttatgcttttgatactacgtatcttttgatctatcagtttcactttcagaaatcaattagacaagtgtataaaagtaagaatacaaggatgttttcagcagtgtttataaagcaaaaaaaaaaggtaaatggtttaaatcttcatcatggaattaagtaaaatacagtaaagatgttcctgacttacgatggtttgacgtataatttttcaactttacagtgggtttatgggatagtaaatacatttttagctaatgatattttcaatttatgatgtgtttatcaagacacagccccagccgggcacagtggcctgtaatcccagcactttgggaggccaaggtgggcggatcacctgaggtcaagtgtttgagaccagcctggccaacgtggcgaaaccccatctctattaaaaatacgaaaaatagctgggcgtggtggcgggtgcctgtaatcccagctacttacaaggttgaggcagcagaatcacttgaacctgggaggcagaggttgcagtaagccaagatcgtgccattgcactccagcctgggtgacagagcaagactccatctcaaaaaaaaaaaagaaagaaagaaacaaccccatcttaagtcaaggagtatctgtgtatccatacattaaaaatgtgttataggccaggcgcggtggctcacgcctgtaatcccagtactttgggaggccaagccgggtggatcacctgaggtcaggagttcgagaccagcctggccaacatggtaaatccctgactctactaaaaatgcaaaaatcagccaggtgtggtggcacatgcctgtaatcccagctacttgggaagctgaggcaggagaatcgcttgaacctgggaggcagaggttgcagtgaaccgagatcacgctgctgcactccagcctgggcgacagagcaagactccgtctcagaaaaaacaaaaatgtgttgtaggctgagcacaatggctcacggctataatcccagcactttgggagggtgaagcaggaggattgcttgaagccaggagttcgagaccagcctgggtaacaaagccacaccccatctctacaaaaaagtgtttaaaacattagcccagtgggatggtgcacacctgtagtcccagcttctcagggggctgaggcaagaggatcgcttgagcctagaagttttaggctacgctgagctatgatcacgtcactgccctgcagcctgggagacagagcaagaccctgtctcaaaaacataaaataaaaatgtgttgtgtatatatatttttaatgtttaaaggatatgaatatattaaatgggaaaagcaagaaaatagaaagtatattagcctgtttttgttagtgaaagaatgtgtgtatttcatgtgtgtgcgtgtgcatgtatagagaaagagtgctgttttaatatatgccgtttacttagctctgagaggtaagcgttctgtttgttacaggattaatacccctcgaagacaaggaggacttgggccaataaggattccacttctttcagatttgacccatcagatctcaaaggactatggtgtatacctagaggactcaggccacactcttaggtacctttcagtggttttatattatgacaaatccaagcgtgtttataatcctccttgaaatagatgttatttatgaaatagaagaacaaattttgatcaagaaatataattttgaggccaggcacggtagctcaagcctgtaatcctggcactttgggaggccacggtgggcagattacttgaggtcaggagtttgagaccagcctggccaacatggtgaaaccctgtctctaccaaaaaatataaaaattacccaggcatggtggcgtatgcctgtagtcccagctactcgggaggctgaggtgggagaattgcttgaacctgggaggcggaggtttcagtgagcccagatcatgccactgcactccagcctgggcgacagagtgaaaaaaaaaaaaaagaaataattggctgggcatggtggctcacgcctataatcccagcactttgggaggccgaggggggcagatcatgatgtcaagatatcgagactatcctggccaaccaacatggtgaaaccccatctttactaaaaaatacaaaaattagctgggcatagtggcatacgcttgtagtcccagctactcgggaggctgaggcaggagaatcgctcgaacccaggaggcggaggttgcggtgaggcgagatcacgccaccgcactccagcccaggcgacagagcaagactccgtctcaaaaagaaaaaaagaaagaaagaaaaatgttactttgttctattagtctttaaactactaaacttaaaccgttagtttatattaccctgattaaactatgttagcatcatagacttttagagctggaagattatttagaggtctttcacccaccctgtcatcttacagataaaagagacagattcatagagttccgtgatcttagccaaagttatataataatttaattgcagagcccagacttaaatccaggtcccccaactccttgtccatttctttttccttttttgcaacctgactccagtaatgtttttttctaaatacaagtgtcatactacttagcaaacctgtgtctttggagtaggaaaaattaaggaaatattttacccagacgctctcactgggttacttgagctaacaaacattaatagaattctttgaaaagggggcaattttagtgtggaacagttgtaatttggttgtattgatttgctttgtagtgccaatagtttttcttgaatgttttatgtgaaagtgtcagtattttataatcctgtgtttttttataacaactttattggaatatagttcacatataatacaatacccatttaaagaatacaattcagctgggcatggtagttcatgcctgtaatcccagctctttgggagacctaggtgggaggatcccttgagcccaggagtttgagactagtctgggcaacataacaagacccttgtcttctacaaaaaaaaaaaaataatttttttttgttaaattaggccattgtggtggcacattcctgtagtcccagcctactcaagaggctgagataagaggatcgctagagcctggaagttcaaggttgcaatgatctatgatcacaccactgcactctcgcctgggtaacaagagtgagaccctgtctctaaaaaaataattaaaattaaaaataaagaatacatagccgggcgcagtggctcacgcctgtaatcccagcactttgggaggccaaggcaggcggatcacgaggtcaggagatcgagaccatcctggctaacacggtgaaaccccatctctactaaaaaaaatagaaaaaattagccgggcgtggtggcgggtgcctgtagtcccagctactcgggaagctgaggcaggagaatggcgtgaaccctggggggcggagtctgcagtgagccgagatcgcgccactgcacttcagcctgggcgacagcgagactccgtctcaaaaaaaaataaataaataaagaatacatttcagtggtttttgtgtattcacagagttgtgcaaccatcaccacaattttagaatgttttcatgctccaaaaaaccccatacccattagcagtcactccatgtttcccctaacccacttcccctggctttaggcaaccacaaatctactttatgtctctatagttgcctattctggacatttcatataaatggaatcctacaatatgtgcttttatgactagcctctttcacgcagcataatgttctcaaggttcattgtattgtatcatgtattgctaccagtagtttcccctcttttgtacttgctaagtatttaatgttttctgctttcataaaatctgttactaagttaatttccaagaataaatatgccccaaaaacgactgaggcagttttaaaatgtggaatcatttgaacattaaccaagtaaaattatctaacgttagctatattatttgacctgagccagtagtttctttttaaaatttttttgttaaggccgggcatggtggctcacgcctgtaatcccagcactttgggaggccgaggcaggtagattgctcaagtccagcagtttgagactagcctgggcaacatggcgaaaccctgtttgtacaaaaaatacaaaaattagctgggcgtggtggcacacacctgtagtcccagctactcagtaggctgtggcgagaggatcacttgagcccaagaggttgaggctgcagtgagccgagatcatgccactgcacttcagcctgggcaacagagtgagatcctgtttgaaaacaaataaaaaatttattatttattttcaaaataatacatgtacatatgcacatagtttttaaaggtcagattatcttcaacaactgtaaatactctggtacatttcttagccaaaaacaaatttttaaagctgcagttttacagtgataattccaaattatacattagattgagggagggatgtccacaggtgtgtgtacgtgtgtgtgtgtgtgtgtgtgtataccattggagtaggtaggtagtgtggtgtttgttctgtatagcatccttttgtgtggatggtataggaattcacaatacataaatgagaagaaatgacctcatctctaccattcttctgttttacagaggtctcttcattattgatgacaaaggaatcctaagacaaattactctgaatgatcttcctgtgggtagatcagtggatgagacactacgtttggttcaagcattccagtacactgacaaacacggagaaggtacctctcccttctaaccttttgattttttagtttgaaagatagcataattagttaggtttcttatcgtaaaagtaatcgatatttccaaagttttctgattatttacaaattattagcagatccttttaacagaccaaattataatttacagtgctttaacaaaatatcaggccaggcatggtggctcatgcctgaaatcccagcattttgggaggccaaggtaggaggattgcttgagctcaggaattcaagaccagcctgggcaacccagtgaaacctcacctctactaaaaatcaaaaaaaaaaaaaaaaaaaaaaaaaaaaatatatatatatatatatatatataaactaatatattctgcttactaaatgagatgcaaaaatattcactatttgcatagtcctttttgataaactcaaagacaaaagtttctgctactgcaatttttaaaattatgtttctgcaagcttagaatgtgtcaatctggcaacatttagtgatgtagttttcatttgcctctttgcattattgaatttagccttttaaataatccttgatcacttctctgcctttcagctaagatgaagtatagtaatgtaatctctgggcttattcagtatcacatttgtaatctacaagttcatcattttgctaaaatagaacacattatatattccttttaaaaatgtcactgagtcaggatgcattctaatgtctcttttgacaaacagtgaatcatgtcatcagtacaaagtactgaagtatacatggcaaacaagcgtactggaagtttatgtaaatttggaggaatttttgccatgcccaggcctttcagctcaccagattcccaaactttccaactgtattagaggggcaatcaatttgatttcttatattttaaatgtaactaaacataattggtaaaaatgaaaatagattagctgcctgcttatgagctccatgactaaaattccttggtgtcaacaggcagctaatagaagtcatgtgctcggtggtctggaaatgttcttattagtatattctattcagtttcatatagaaacagaaaaagtcagttgctgaaggtaactgaattctgtttttaaaatgtcttctgcctctttttgtttcttttagtctgccctgctggctggaaacctggtagtgaaacagtaagtatatatatatgtttttatgttgagttgatggttagagttgaaaaaaatgctggccgggcgcagtggctcacgcctgtaatcccagcactttgggaggctgaggcgggcagatcacgaggtcaggagatggagaccatcctggctaacatggtgaaatccgtctctactaaaatacaaaaaaaaaaaattagccgggcatggtggtgggtgcctgtagtcccagctactcgggaggctgaggcaggagaatggcatgaacccgggaggtggaggttgcagtgagccgagatcatgccactgcactccatgctgggcgacagagcaagactccttctcaaaaaaaaaaaaaaaaaaatgctaaccttagaataatcttcccttgttactagaactgtcttgattttgtaaatgaagtaaacattgctaagcagaaatcagagtacagacattctttggcctgtaggaagagtagctgaaaccggagaaagcagaatatggggcgtgatgctgtgaattttaaagccaggtatacagataaatacaccgttcgaaaaaaaaaagtagggcagagtggagacttggtagaataattcagaggtcttataggtcatgtatcgaatttcttcctgtattgggacaaagaaaacagtcacaagcaaaacctttctatgcatagtaagaggttttgagaaaatctagctcaattaatactgaagataatgattctctccttgtcatgaagaaagaaaagattgaaacacgtatattctttcatttaggaggctgtataatttttttttcttttttgagacggagtcttgctctgtcgcccagactggagtgcagtggcatgatctgggctcactgcaacctccgcctccagggttcatgcaattctcatgcctcagccccctaagtagctgggactacaagcctgcaccaccacacccagctaatttttgtattttttggtagagacagggtttcaccatgttggccaggctggtctcaaactcctgacctcaagcgatccacccacctcagcctcccaaagtgctgggattacaggcatgaggcaccgctcctggcccaaccaacctatttatgaaagcatttattaccacaacctaaaattagaattaggatataactccaagggcagggactttggctgtgttgttcactaataaatactgcctatcataataccttgaatagtttccatatagtgagtctgttgaaagaacgtccaaacacataaatatatacaactattatttgtcaatcaatcaaaaattaaaaagaatgaccaccacagtatgtgataacacgtatgcatttttctggagggagaatccatagttttcaccagattctcagagatttgtggcccccaaaagttaatcatgtaaatagtcaacatgttttccgaaatgtccggtactcatcctataatacctttcagagtgaaattgtacttcttgggagctctcactgatctctgggaacttggacacctagcacatgcctgtgattggagatgatgttttcatcagtcacagagggttttgctgcacctccagggggaagtgccccctaccttgaagatgtgtctgaaatgctttttaaggcttcttaagctgctgcttaagccagcagcttctgattcatatttctttctataagcctcataatcaacaaatgtaaactaatgtgactgatttatactttaaggtacctagtggtcaaagtacctttaatgtgtaatttcaaatcccctttgagatccatcagattaacatagagatgagtaagtttgctattgtaacattaactttgacctcaaagcaaaactgttttgcaaacccatcagaaattgattcagaatcagtcaattacaaaagttacaataagttatttttatatatataaagatagatgtactttacctataactagcaaataacataatgtgaggccaaattatattggaaattttttttaagtctaacaggattctaaggctgtgatgctcttagagggaacacaacagtattcattaactattgacagtagtgcttgatgtatttgagtttgggttttttttttgtttttttttttttactttgcagcttgagatttaaaaggtgtattctggactttagtgagcccttagtgaacacctgcctccttttcagataattgtgacataccatcattttagcagcatgattttaaaagtacattaacatctgtagccatgctctctaaatgtgtttgacttaattagatcaaacctgaagataccatgaaagcctggtggccaagagagagctgtaagtaagttttggggtgcttgagtacagatgttaatttattcacacaaaataaaaatatttgtcttttggaatagccgaaattagtaggcaggacaaatctcatttttttctaaatatacaatctgatatacaaaaataatttttagtcaaggcatgggcaactaatgtcagactactcattatgtactttggctttaaaatgaataatttcctttcttcgttttgttttaacagataatcccagatccagctggaaagctgaagtatttcgataaactgaattgagaaatacttcttcaagttatgatgcttgaaagttctcaataaagttcacggtttcattaccacattgtgttgcagtagtaatttcttggagaatataaaaatccacatcaaagtccaaagatatttagcgttagcgttagacactgatgccaaaagacaagcagttattctctgtctttccaaaggaagaaatgggagattgaatcaaactgagtaatagcaataatgacatttacggggtacatgccatgtgccaggccttgtgttaagcaggttaggggcattatttaatcctcacagcaactcattgagttctttattttacagatgaggaaactgaagtgcaggtagattacttacttacccaaagtcacatagctagctagcaaaggcaaaatccgaccttgcacccagacaggctaattctagtttctgagctcttaacactccactgtggctcacctctccatacctttgagggtagcggtaaagaacgggttgtgagcacactcaccttccacagtaataggaatagctggccccatggcccactgctctgtaataacataaagccttttgcccccgccgccatctctaaatttacatcttcagcttgtaccaaatttataagttagatatttagtttaacaaaatttgaatccttaaatacatataactagctcttaacaaatgaccatatacaaagctgaactccagtgctatttcatcatcccatttgccaccccaatatggcaattactttattgtcattatctgtagacatgccatgtagttaagagaccaggtacccaggagaattaacttcatcctgtcttccatgctaatctgctaatctctgtccgttttgtttctgagacagggtctcactctgtcacccaggctggagtgcagtggtatggtcttactgcagcctcaacctcacgggctcaggcaatcctcccacctcagccccccaggtagctgggactataggcatgcaccaccatgcccggctaatttttatgttttttgcagacatggggtttcaccatgtggcccaggctggtcttgaactcctgagcctaagcaatccacccgccttggcctcccaaagtgtgggaagatgcatgagcccctgtgcctagccatcccctctcttaatacaaaaagcccttctcctggggaaaggccatcactagaagtggtggggggattactgggcttctggctgaaattgaggtctgtcgcaaatggcgggtgatttgtagatacacaggaatccagctgccatttataacctttttctatagcagagtatgttctaatgctagtttacagttgaagttttataaaccaatctattagtaaagttgaagactgctagtactttgatatctaaacaggtttgtgataaccttgtcaataggtccaatacaatgggaattctatatgcagatttcctccttccaatctaaaaagtacaaatgttttactcatgaaataagctggtatccctttttttaagagtcagggtctcactctgacatcaatgtatttatgtgtctgtatatattcatacacgtacactccaagctggagtgcagtggcataataatggctcactgcagcgtcaaactcctggcctcaagcgatcctcctacctcagcctcccaagtctctgggactacaagcatgcaccagcagcatcttcttgattaatagtttccattctttggagcttttctagcctcctgttcattttagtatggtttacaaggagaactatttgtaggtccacccagaaaaaccagtcattaatgtttcattcaacattcagcaactattgaccacctaaacacttggcgtacatcaatgaccaaataacaaatttctgccctcaaggagctcagtatttgattactgaagcgggtgctgatagaatagtaatttcttggtactcacaagtaagtgaagatacataccctgacttgccactttttttttttttttgagatggcgtctcgctctgtcacccaagctggagtgcagtggcacgatttcagctgactgcaacctctacctcctgggttccagcgattctcctgtctcagcctcccgagtatctaggattacatgcgtgtgcctccatgcctggccaatttttgtatttttagtagagacggggtttcgccatgttgctcaggctggtgtcgaactcctgaactcaagtgatctgcctgcctcggcatcccaaagtgctgggattacaggtgtgggccacagcgcctggcctctcaccacttttcgtattaactgagtgatatacatagcttccgaataaaatagcactaaatgcaccccttttgtcagtgccttttataaactatcccttcaaagagctgacttctgaaagtccataaatccaagcttacatcttaaaagatggtctcgtggccatttacaagactggaaaaagagttgagaaaggatagtcccctgccctactggagacgatggaccctgggcctaaccaggatgcagctactagagacctattcccagaagatgctgacctaccataatctggagcagtgcttctcaatggggagggatggagattttgcccccaggagacatggcaatatctgggatgtttttattgtcaaaactgaaaatacagccgggcgcggtggctcacgcctgtaatcccagcactttgggaggctgaggcgggtggatcacgaggtcaggagatcgagaccatcctagctaacacggtgaaaccccgtctctactaaaaaaaatacaaaaaaaattagccaggcgtggtggcaggcgcctgtagtcccagctactcgggagtctgaggcaggagaaaggcgtgaacccaggaggcggagcttgcagtgagccgagatcacgccactgcactccaacctgggcaacagagtgagactccgcctcaaaaaaaaaaaaaaaaactgaaactactactggcatctggtgggtagaggccaagggtgctgctaaacatcctacaatgcacaggacagtcccacagcaaagacttttctgcttcaagatgttaactgtggcaatgttgagaaaacccgctctagagactaaggaaaggaggagaccagtatcatttagtagctgcctgtacagcaggaggtcagaacaatgccacaacagtaggagcttacccaaaataatagatcaagagatgacctgcccacaaacatttaaaaaatagtaaataaggccggacatggtagctcacgcctgtaatcccagcactttgggaggctgaggcgggcagatcacctgaggtcaggagtttgtgaccatcctggccaacatggggaaaccccgtctctactaaaaacacaaaaattagccaggcatggtggtggatgcctgtaatcccagctaccggggaggctgaggcaagagaatcgcttgaacccgggaggcggaggttgcagtgagccgagatcacgccactgtactccagccttggcgacagagcgagactctgtctcaaaaaaaaaaaaaaattagtaaataaataggaggccaggagcagtggctcacgcctataatcccagcactttgggaggccaaagtgggcagatcacctgaggtcgggagttcaagaccagcctgaccaacatggagaaatcctgtctctactaaaaatacaaaaattagccgggcatggtggcagacacctgtaatcccagctactcaggaggctaaggcaggagaatccattgaacctgggaggcggaggttgtggtgagccgagatcaggccattgcactccagcctgggtaaaaagagcgaaactccatctcaaaaaaaaaatgtaaataaataggtgactgactggccgcggtggcacacacctgtaatcccagcactatgggaggcctaggcgggtggatcacctcagatcaggagttcaagaccagcctgactaacatgatgaaaccccatctctagtaagtacaaaaaattagcttggcttcgtagtggacacctgtaatcccagctacttgggaggctgaggcaggagaatggcttgaacctgggaggcagaggttgcagtgagccgagatcgtgccactgcactccagcctgggcgacagaatgagactccatctcaaataaacggaagtgacctgaagtttctatgaaacacaccaggcaatatctttccagtgcactaatatatgaatgacatctattattccctgcttctccctataatttctagtcttctgttgaatatttcacatttaagcctggccagtgttctgaggtttccagtgatcatggtggacagctctttcagggatttcttagtccctagaatctcacacaagagatcattcctcacgccctccccaccacatccccattgtctcttctctgtccaagagctcatctaaccctacatcctaaacttcccatctgtcactaggtttccaggttgtatattttgttctcaaacacattaactactattttattatttaatgatattttggtatcctaacccccctatgaactttgtgacaacactatgtcactgagaaatctttgaatacaaggttattaatatataagatgtaacaaaatatgtgtttcaggtaaataatttcatagaccgggcgtagtggttcacacctgtaatcctagcactttgggaggccgaggcgggcgaatcacttgaggtcaggagctcaagaccagcctggccaacatggtgaaacctcgtctctactaaaaatacaaaaattagctggacgtgctcgcttaaacccaggaggcggaggttgcagtgagccaaggtcgtgtcactgcactccaaccttggtgacagaacaagactctctctcaaaaaaaaaagtttcataaaagtgtctgcagtggaggggaatatatatacacatatctatgtatttgtgtgtctatatatattcatacatatatatagggtcaaaaaacttttacagctgggtgcagtggctcatgcctataatcccagcactttgggaggccgaggcaggaaggtcacttgagcccaggaatttgagacccgcctggacgatatggtgagacctcatctctacaaaaagtataaaaattatccaggcgtggtgtcttgtacttgtagtcccagctgttcctgagcctaaggcaggaggatcatttaagcccaaaaggtcaagccctcagtgagctgtgatcacaccactgcactccagcctgggcaagagagcaagaccctgtctcaaaaaaaaagaaaaaaagaaaagaaaagaaaaagaaaaactgtttttcctctgttctcacatgacaacaatcaatacagaagacttctgtgaccaaatgtgtagggtgtagggattttccccaccaacaggcaagcaattctgcagtggacaccagccaggaatcttctgatccaattcaattctgatgctgtccacctggatatagcatcagataccacaggttgagggctcagacccacaggactgcccccacttcagacaccagctcccaagtacaggcctctggaacttctgactgactgacttcaagttggggttcccatgaccccctctttaggctcaattgttagagcagcttgcaaaactccgggaaacgcccacttacacttaccagtttcttatgaaggatattttgaaggatacgaataaacacccagatgaagaggcacatagggcgaggtctggaagggtcctgagcacgggagcttctattcccgtggagttggggtgcaccatcatcccaacacatgggtgaattcttgttcaccttcctgcaagccttcaccagctcagctgtccagaagttctgcgtacctggtcctcttgggccttttatggagacttcattggataggcatgactgaagcatggacaaccgtgtcaaaatgtgattggatcgcttctcggccttttggctaagatcaagtgcaaaacgtgattgggcaaaaagggcatgatctaatgctaatagacggagtggggaatcctagcaaggcctgtccagattcctgttggcctctctgcacggcactccttcctcctgggttgagggcaggaccctttctaaaatgaggatcttatgacctacaatcagacaaggtaggtcagagaatttctttatgaccggctccaaatacaaaggtgggggcagattatattttcagtttctatggcctgccttggagagacaaaggagcaggtgaaaaaggagagtatgagaaggtcagcgggagaggctgttttctgagccctgcttctgaggcctacagcacccgcacattaaaaccaaagatggtcttttcctttgatcgctctgaagcacttccaaagctgcttcaggaaccaaggactaaaggacgaacactttaacaaaagatatgcttattgcttaatcacttgggaaataataagggctatgggagttatgagccaggaaccatggacaaaaagctatatatatataatgatatcacatatatataatgatatcacatagatatacatatgtatatatacacacacagatgcttctataaactcatattttttacctagcttttcaacagaaaagaaaatgtttatcatagttactatgtatttagtttcatatagcaaagtaatttttaccaatcctattactaaataacaattttagcataatattgtacatttatgtaaaatgctaaaaatatattttatttatttattttgagaggggctggagtgcagcagcacaatctcggctcactgcagcctctgcttcccaggttcaagtaattctgcctcagcctcccaagtagctgggattacaggcaagcactaccatgtctggctaatttttgtatgtttagtagaggcagggtttcaccatgttggccaggctgacctcaagtgaatggcccgcctcagcctcccaaagtgctgggattacaggcatgagccaccgtgcccagcccaaaaatatattttaaaagagcctccttcctgagtcttaaacttacaattttttttaattaacaaattcaaaagccaactcgaacacccaaattcacctaaatcgtatatttgttcacacaaaaaacatttattacctaaatatgtgcaagggactttgctagacaataggaataaaaagatctgatacaattccttccctcaagaagcccacagtctcataagtgaaataagcatgtaagaaaaggaattatggccaagcacagaggctcacgcctgtaatcccaacactttgggaggccaaggcaggcggatcacttgagcccaggagttcaagatcagcctgggcaacatagtgaaactctgtctccacaaaacatttaaaaattagccagatgtgatggtgcacgcctgtagtcccagatactcgggaggctgaggcaggaggatcactggagccctggggtagttgaggctgcagtgagccatgatcataccactgcactccagcctgggtgacagagtaagaccctgtctcaaataaataaataaataaatatttaaaaatggaattgcaataccttggaataagtgctaaaaacaccagctcctgtggaggttccatggtgagcacaaacaaccacaagaaaaatcagggatggaatgagggaaggtttcacagggaagaagaggtgtacacccatttcccatttctccactgaaggccatatcatctgcaagtagcccttacagaagaagacagtacttatcacccaacgtcaagagaaccaaggactgactggttttcctctttgatgattatctactgggaaatggcacatattttagagttgattggctagggttaggggtcaaatgtggggccaaggccagatggaaattttaagaattgaatcaaggctgggggcagtggctcatgtctgtaatcccagcactttgggaggctgaggcagaaggatcactggagctcaggagtttgagaccagcctgggcaacagagtgagaccccaactctataaaaaaattgttaaaaatagccaggcctggtggtgtgcgcctgtggtcccagctatttgggaggctgaggtgggaggatcacttgagcccaggaggtccaggctgcagtgagccgtgatcaagccactgcactccagcctgggtgacagagcaagaccctgtctcaaataataataataaaaaaagaatggaatctgtagtcttgatttcattacttcaagctctggctatttgtacagttcactctggacatcagaaacaggatttccaagttgtgttaaagggaatacactgcactgtaacacaaaggccacaagatggcacccagcccacagaaagcaaacagccacttgtgaagccggggcgggtggggatgggggtgggggcgggggggtgcgccgggggtggggggtaacgcgggggagcgttaccctaaactaaaagagcaacaattaactgtcaaactaatgtttttacaaatttaatttattaaaaaacaggaaaataacttagaaattcagaacaatttaaaactaagcacaacttaaataggtatgtgaactttactaagtatactccttccatccatgatggaaggtcaaactttttaaccataatccatgtagaagtacattttacattgtgacctagtactcacgtagatgtgtgtaccatgtgcatacataacgtgtcacacaacacttaacattactatgcatgatgcattctgatgttttttctttttttaaatattcaagcccactcatttttatgtcctactaatttcaagcccatagttagaaatatatatatatattttatatatatataaactgtctaaaaatatatattttatatatatatatatatatatatatatatatatatatatatatatatatatatatatatatatttagacaaagtctcgctctgttgcccaggctagagtgcagtggcgcaatctcagctcactgcaacctccgcctcccaggttcaagcgattctcctgcctcagcctcctgagtagctgggactacaggcgcccgccatcacgcctggctaatttttgtatttttagtagagacggggtttcaccatgttggtcaggctagtctcgaactcctaacctcgtgatccacccgcctcggcctcccaaagtgctgggattacagacgtgagccaccgtgcctggcggatatatatatatataattttttttgagacagagtctcgctctgtcgcccaggctggagtgcagtggcgcgatctgggctcactgcagccttcgcctcgcgggttcaagtgattatcctgcctcagcctcccaagtagctgggactacatatgcgtgccaccatgcctggatagttttttcatttgtttgtggagatggggctttgccatgttggccaggaggtcttgaactcctgggctccagatatccgctcgcctcagcctcccaaagtgctaggattacaggcatgagccaccacgtctggccctaatcccttcttttaactcctcttttctgtttcctattttatagtaaattcattacttgctgccaacagaagggaaagaaaacacaactcagctgggcgcggtagctcacacctgtaatctcagcactttgggaggcgaggcagaggaggtcggattacccgagttcaggagtttgagaccagcctggctgacatggtgaaaccccagtctctactaaaaatacaaaaatgagttgggcgtggtggcgggtgcctgtactcccagctacccgggaggctgaggtagaagaattgtttgaacccgggagacagaggttgcagtgagctgagatcgtgccactgcactccagcctgggcgacagagtaagactccatctcaaaagaaaaaaaaaaccacaagtcaatttagagagtcaatcacaattgtcgcaaaagttttattctaagaggaaataaaccaaatgcccagaacatttcagccataattcattcttatggttgagacttgactgcattctgatccatatatagatggcattagttaaccctttactataatagctgagaaaatatgtcagaaatgtggcaaaggaccaaaattctagacctagtctcgcctctcccacttatatagttacaagttaggcttcaggaagttaccttccctctctaagcctgtttcctcatctgcaaaatgtgggtaataatagtactgatctcaaagaattactgtaaggattaaatgagagtatacattttaatgtcactagtacagtgcctgacacatatgtgttagccacatataaaaattatatgattacatcttttttttttttttttttttgagacagggtctccttctgttgcccaggctggagttcagtggcacgatcttggctcactacagcctctgcctctgggcccaagcaattctcccacctcagcctcccaagtagctgagactacagggacacaccaccaggcccagctgatttttctattttttgtagatacagggtttcaccatgttgcccaggctggtttcaaactcctggactcaagcaatccaccaaccttggcctctccaagtactgagactataggcgtttcaccatgctggccaggctggtctcgaactcctgacctaaagttatccacctgccttggcctcccacagtgctgggattacaggcgtgagccactgcgcccggcacttattatttttttagagacagggtctcactctgttgtctcactctggagtgcagtggcactatcacagctcattgcagcctcaaactcctgggctcaaacaatcatcccgcctcagccttccaagtagctgggactacaggcacgtgccaccacgaccggctaatttttttattttctgtagagatagggtctcactatgttgccaggctggttttgaactcctggcctcaagcaatcctcctgcctcagctgggatttcaggtatgagctactgtgcctggctgaaactttctttttaatagggacctcttaatcatccaatcagtggccttttcccagtattcatccttaccaccttcagtgacaccactgatccctccaagaaaatggctttgagaggaaggagggtgctgtggttaagacccgggaatctggctgctcttagagccctcaagccaccatttaagaaatccaaggccgggtgggcacggtggctcatgcctgtaatcctagcactttgggaggctgaggcgggcagatcattaggtcaggagttctggaccagcctggccaacatggtgaaaccctgtttctactaaaaatacaaaaattagctgggcatggtggcacgtgcctgtaatcccagctactcagtagactgaggcaggagaatcactttaacctgggaggcggaggtttcagtgagctgagatcttgccattgcgctccagcctgggtgacagagcgagactccacctcaaaaagaaaaaaaaaaaaaagaaaaaaagaaaaaaaaaaaaaagaaatccaaggccgggcacagtggctcacgcctgtaatcccagcactttgggaggccgaggcaggcagatcacttgaggtcaggagttcgagaccagcctggccaacatggtgaaaccccatctctactaaaaaaataaaaattagctgggcgcggtggtgggcgcctgtaatcccagctactcaggaggctgaggcaggagaatcgcttgaacccgggagccggaggttgcagtgagccaagatagtgccaatgcactcctgcctgggtgacaaagcaagactctgactcaaaaaaaaaaaaaaagaaagaaatccaaccaggctggtagccagccacctcagccaccccagctgaggcaccagatgtcccagccccagatgaactcccagatgaacagagctgactgagtgaccttagccaatgctacatggaacagaagaacctcccaggtgagcccagccatcccacagaatcaagtatatctttagaaagataaactgcacaaactaattgaaaagaaaaagaaaaatgttgaaaccccaggggagttgggtgcaacttcagttctctaggagtcaagtgcttggctctattcaaaaaggtgcaagaaagcagattggatcagagcaaacacaggtatcagatggaacacgttgacagaagatttgggttaccacagaatcacatggacatgcccaacacagtgcaaagcatactagaatgaagtaaactctcctaaagaaaccagtgaaaaagacagcatcctcaaagactacacattgaagaagcatggaggcaaaaactaagaacttggtaataaatgcctgaagtaaaactgggatctcagcacagactatttaatataaaacaatgtccaactcacatgaggaagatgtatgctagaacttagcagtgctggtgctgggtaaaaattctcctttaacttttttttcagacgcagtctcgctctgtcgcccaggctggagtgcaatggcgccatgtcggctcactgcaatctctgcctcccaggttcaagcgattttcctgcctcagccacctgagtagctgggattacaggcacctgccatcatgcccagctaatttttgtatttttagtagagacggggtttcaccatgttggccaggctggtcttgaactcctgacctcaggtgatccgtccgcctcggcctcccaaagtgctgggattacaggcgtaagccaccgctcccggtcaaaaattctcctttattctttgagagggacataacactaataatccagaacctagtgtatatccgttagtttgcttcacctcatcttcttaaaagtcctgtattaaaaaccaaaacctctagcttttatatctgtattggtagaggacagatttggggtgaagattctggtatccaaaattacgtgagcaatttaacaaaaagacaacaaaaacaataagcaatttaatttcaatctcagtagaattcagagaaaggcaattaacaaatgtcagttttctttttttgggggggtggggggggacagggtttcacttgttgcccaggctggagtgcagtggcgtgatcttggcttactacagcctcaaactcctggactcaagcaatgctcccagttcagcctcctgggtagctgggactacaggtgtgcaccatcactctgagaggagttagctagctttccttaggtagacagcaagggaagggtccccaaagagcccccaacccacgggtcagtgcctcatccccacagaacagagaaagcagcctggggataaaaatcaagctgcaggcaccgataagggaagtagcacagggtggtggtgtgcctggagacaagcccgcggctgcacagatccgagaacctccagcccacttagataaaaacttgcacaaacctccagctcactcagataagggaacaagacctgacatagaaatgtctttgtcttttgtataatcagcaggttcccgggaaaaagtttcttctcctttcgtgggcattaatactgtgggctccgacgactccgatgggcactttcctttcctctttcgactgtgagcccggcctctaagaattacttcagcacgattggtccccgggccaagctttcacttcagctcctgataggtcccgggccaagctgagtggtctcaatgaatcatcaattcagctcctgattggtcccgggccaagctgaatctagctttctccaagacagctcacagactaagcaaattccttccccttcccagtccgcaaaaacccccgaccccaacctcatagtgggcaacccgttcaggcccccactctccgctgcggagagcttttttttttttttttgagacggaattttgctcttgttgcccaggctgaagtgcaacggcgcgatcctcaactcaccgcaacgtctgcctcccggcttcaagcgattctcctgcctcagcctcccaagtagctgggactacaggcgtgtgccaccacgcccagttaattttgtatttttagtaaagacagggtttctccatgttggtcaggctggtcttgaactccggacctcggcctcccaaagtgctgggattacaggtgtgagccaccgaatccagccgagagctttcttgttttgcttactaaacttttgctccaacctcacccttgtgttcgtgctctgtgacacaaagaactccggatactatctcagacaaccaaagactgctacattttggcgcactggtgagactacaacaccttgctaatttttgtatttttgtagaaacaggttttcaccgtgttgcccaggctggtcttgaactcctgacctcaagcaatctgccttggcctcccaaagtgctgggattacaggtgtgagccaccacatccagcagaaggtcattcttcacctatcaaaatggcaaagatattttaaaaagaaaagataaaaattggcaaagttcagggaaattgctgatgtgtaagtgattgtgtgaaactgttctgaagggttacatgaaatacatattcaaagccttcaacgtgtgcctactatttgacctaaatatctcatttaatatttttccaaagaaaataatttaagggtcaaatgttttagagtatttaggatatttactgcaacattgtttataatagcaaaaaagaaatactagaaaaagcttcactgtacagcaacaaatggttaaatatataatgtataatctatacaatagcatgcagtaggtctcttaactccacttaacacattcacaaaactccccagggcgcatccctccccattagccacctcccatcatgtcataggtagatatgcaaaatgctatattgaagggccaggtaaatctcagtcaggatggcattacggcatggagagacaagttattatagtacagcacatgcttgattccatgagtcaaactgcatgcttccaagagatagttgtgttcgctcctgtgactatttcatgccagaggtgcttgttgacactgtgatttcaataaacattacataaactaatataaaaaaattgcttgagacagggtcttgctgtcacccagactggagtgcagtggcatgatcatagctcactgcagactcaaactcctggactcaagcaatccactcacctcagcctcctaactgggactacaggtgcacaccaccatgctcagataattttttaactttttgtagagaaagggtctcactatgtttcccaggctggtctcaagcgatcctcccatctcagtctcccaaagtgctgggattacaggcatgagccaccactgtgcctggcctaaaaattttttgttaaaaatgctttccaccggccgggtgcagtggctcatgcctataatcccagcactttgggaggccaaggtaggtggatcacctgaggtcaggaatttgagaccagctggccaacatggtgaaaccgcctttctactaaaaatacaaaaactagccaggcatgggggctgacacctgtaatcctagctactcaggaggctgaggcaggagaatcgcttgaacccgggaggtagaggttgcagtgagccaagatcatgccactgcactccagctggagcgacagagtgaaactctgtctcacacacacacacacacacaaaaatactttccacctaattctgaggcagagccaagtttgtgaacactaatgtagaacccacaataaatattgcttccttcttgggaggacttttttcagagattattttttcttctaagttaccttcctgtcaaaaaaggaacggtcttggctacagatttttttttttttttttttttgagatggagtctcgttctgtcacccaggctggagtgcagtggcatgatcacagctcactgcaacctctgcctcccaggttcaagcagttctctgcctcagcctcccgagtagctgggattacaggcgtccgccaccacgcccggctaatttttgtatttttagtagaaacggggtttcaccatctcggccaggctggtcttgaactcctgacctcatgatccatccgccttggcctcccaaagtgctgggattacaggcatgagctaccgcgcccggccttggctgcagattaacgggaatacctcccttgggcttcctaggtgacactgtgatattcggtatgacctcccttgctctattccttggaagaagtacaggcactggtcaagagtgcccgggacccacattgcctggttttgaatcccagcacctccacatgttacgcgtcggacctccaggaagttacttaaactctctgtgcttcagtttcccgagtggcctaaccctaaggggggttacagaacctgcctcatagtgttgattggaagaaataaaggagctcagacctgccaagggctgaggatggtgcctatctagcacatggcaatgctccataagcataagcagctattattattgtggttcctattttttaaatcagatatatcctgcggagccactagcagaatgtgctaaatagctgtctggtgaatgaaagaatgaccaaatggtcctgtatttccttatctagatcatctctaaacaccttctaatggtatggtttcagacctaaatcttcccacaaatctttacggatgcagtaacttttgttaaatcccttcgccccaacttttcatctaccctctgacaacaaaagctgggaaatagagggaagcaaaggaatcatgtacggctgatgggatttagacagcacagagcaagtggttaggtttaaagaacgtcatccaaataccctggcaggaaaccttgtatactgacagttgcaatatgtgtaagaaaagaatgcatccaatggtatcctcaattaattaattaattaattaatttttgagacagtctctctctgtcgcccaggctggagtgcaatggtgcaatctcagctcactgcaacctccacctcctgggttcaagcaattctcctgcctcagcctcccaagtagctgggactacaggcacatgccaccacggctaattttctgtatttttagtagagacagggtttcaccatgttggccaggatggtcttgatctcctgacttcatgatccgcccgcctcagcctcccaaagtgctgggattataggcatgagccaccacgcccagcctctcaatttttttgttttttcagaagatgggaggcaacatggtaggttcacaattaaaattgtcttgaaagtatttattgtttaataattctttctcccctcagccccatccggccactctctctttctgcttttctgatcatcctaaaggctgaatacatcctcctcctgtgtggaggacacgaagcaatactaaaatcaatacactcgatcaggtcttcatcagataccacgtcactgtgggtagagtgctagttttcaacaaatgtggtgttcttagggctccacaaggtagtcctttctcaaggtcgctgggccactcatggagttgaaatgccgctgcccatctaagtacaacatggactctgaaacacaagaaagagaaccttggagaaacttgtaataccgtagaaaaccatcatatcatcatacaaacacaagactacttgggaacactgggacagaacaagatacactgttgggccggggtgtgccacattcccaaaggagcaggccatgactcctgtccccttcctttggctggatcagttttttttttttttttttttttgagacggagtctcgctctgttgcccagactggagtgcagtggcacaatctcagctcactgcaagctccgcctcccaggttcacgccattctcctgcctcagcctcccgagtagctgggactacaggtgcccgccaccgtgcccggctaattttttttttttttttttttttctagtagagacggggtttcaccgtgttagccaggatggtctcgatctcctgaactcgtgatctgcccgtctcggcctcccaaagtgctgggattacaggcatgagccaccacgcccagcctggctggatcagtttttgactaccagtggttgcttgcccgcctgggggccacaggcatctttggccttcagggctgccaaatctcaaaagcaaaatctcctgaagacatgctcttgtgctgacaggcatcaatacacttcctccaattcaaaaggagaaaaatgtccttagaagttcttccctttgttagggacaagcaataatcactacttacctccatatgtttttgggaaaaccaatggcacttctttttccgacatgaacgtgaaatgaaagacattggtggttgtatgctgcttctcctgcagggaggccacttcactgtgtactctgacttgaatataattattctgagtaaagcatacctaacagattatagacactataatcagtcaactgcattaggaaggggaaaaaggcagtcataagagaaaacagtggctttttgatatagaaacttctaggctcaaatgaaaaaaaaaagttgtatgtcatctctcatcacacacctacctgtgaagaaagaaagagcaatgagccaacctcaacaggtttctgaaacatgatgtcatctactgctaccacaaacggtcgagaaccactgttgggggaaaggacagaatttggggtatattgcaaaattcagatgatctcaattgtttcctctaacaactagctgaagcaaaataaaaatgaacgaagaataaagttagagaagggggaaaagatcctaccagtgagaaatggtaagagacgccatcgtgagcagattagggccaaaataactatatcttttcctttctacatatcatcactgtattttctcagtagtttttttaatgtatgaacttacaaagtcagagaaacaaccttctaaaatgaagatcaaattcagctggtatcagtgtggtattcattcaaaaacataacatattcccacacacacccagactggtccgaaatgtttcatttcagtggggtgatataaattgcttctcagaagttaaggctgccttacatgtaactcacccaaagctacaagcagtagcccacgcaagttcatatgccttcctcataaggaaaccaccaaagatccgattgaaaatgttccgctcctacaggacataaataaatatcaataaatacaaaacttatggccacctttgtatacagaacagaggaattaacaatgccacaggacaaaggccagtttaaaggtgtgtcaaatcttggacaaatatcatgaacggaagctatcctattcggatttctcactaaattataatacctgagggtggcaaatttccaaactcttcagttttgaattctccatccacactgcattagagggtaaaactcgactccgaaaacttatagtcctgtacaaatgaatatttattaaaccctgttaatgccatggttctcttgttgaaaagtaaaaacatttgcaagtcactcccaatacactcagacaactgtggctctggagaaggccaaggtttaggccaggcgcggtggctcacgcctgtaatcccaacactttgggaggccgaggcaggcagatcacatgaggtcaggagcttgagaccagcctggccaacgtggtgaaaccccgtctctactaaaaatacaaaataattagcaggcgtggtggcgggcgcctgtaatcccagctacttgggaggctgagacaggagaattgcttgaacccgggaggcagaggttgtagtgagccaagatcacgccactgcattccagcctgggcaacagggtaagactccatctcaaaaacaaaaaaggtcgggtgtggtggctcacgcctgtaatcccagcactttgggaggtggagacaggcagatcacctgaggtcaggagttcaagacaagcctgaccaacatggagaaaccccgtctctactaaaaatacaaaattaaccaggcgtggaggtgcatgcctataatcccagctactcggaggctgaggcaggagaatcacttgaacccgggaggcagaggttgcagtgagccaagatcgtgccattgcactccagcctgggtaacaagagcgaaactccgtctcaaaaaaaaaaaaaaaaaaaaaaggccaaggtttaaatgttttcccaacgtggaatctcaccatccttactttggatccagtgtgctgagaaacatctcatgtatggtggtcctctcctcagcgctgggggccattttcagtaacgacgtggagctgaaggcaattcttctccccttgttcactggaacaagggagaataaggagcaatgatcaggacggtcgcactacagcacacggtattctgacctgggatgcctttcaaaatctcactgaaaattatacacgtatccaagagaaaactgcagaggccacataaaactcccagtgagtctttggttccacatggaaattatattggttcagtgtgagatcacttgatatcatcctgatccagagccctgacctgcagttatcccattgagatgcatttctcacttcattaaaacggagaaaacaggccaggtgcagtggctcatgcctgtaatcccaacactttgggaggcggaggcaggaggattgcttgagtccaggagttcaagaccagcctgggcaacatagtgagacccctgtctctacaaagaaaaattttaattagccaggcatggtggcacgtgcctatagtcctagctactcaggaggctgaggtgggtggatagcttgggcccaggagatcgagactacaatattgttcattgtagcctcaaactcctggacccaagcccaactccagcctgggcaacagagcaagaactgtctaaaaaaaaaaaacggagataacaaattacttcacttaataaatattgtctgatcaataaaatcattcaaagtatggactccaaagaaaaaagaatagcatatttttaatttcaataaattattggtatgaataagacatttgggccaggcacaatggctcacgcctgtaatcccagcactttgggaggccaaggcaggcggatcacgagttcaggagatcgagaccatcctggccaaaatggtgaaaccccatctctactaaaagtacaaaaattagctgggtgtggtggcgcgcacctgtagtcccagctactcaggaggctggggcagaagaatcacttgaacccaggaggcagaggttgcagtgagccgagatggcaccactgcactccagcctggcaagagacagagagactccatttcaaaaaaaacaaacaaaaaaacaaacaaaaaaaagacatttgactggtatgaagagcccatataaaatcttaaataatctcttctgcagcgtaattaatgtgcttttcaaatttattttattataaacaaattaatgtacattccccttgtctaaagagctcctcttcctctgggctttcagggatgagtggatttacaaatgccggcctaaaaagaagaaaaaaaagaatataatttaagatatgccattatctaataaaacttgaagatgaacaatcacctactacttttaaagaatctgcttttcattttgggtagtgcttactgcttgccttacatgtgaacgctggaacaattagggaagccttacagttacagccttaattgcacactagaaacttaacattataaaaaggatactggcatctgctaaatgtttaacctgattctaatcatgaggaaacagtcaaatataggttgtagaacactctacaagaaaactggctttaggccgggcgtggtggctcacgcctgtaatcccagcactttgagaggccaagccgggtggggatcacctgaagttgggagtttgagaccagcctgaccaacaaggagaaacctcgtttctactaaaaatacaaaattagccgggcgtggtggcacatgcctgtaatcccagctactcgggaggctgaggcaggagaattgcttgaacccaggaggtggaggttgcggtgagccgagatcgtgccagtgcactccagcctgggcaacaagagcgaaactctgtctcaaaaaaagaaaaaaaaaaaaaaaagaaaaagaaaactggcttgaactctttaaaaatatcaatttttgaaagacagcaaatggcagagagactattctaaagaaacaggataaccaaatgcaatatacaatccttgatggattgggtcctgaatcaggaagatagctataaaggacattttagggacaactggtgaaatctgaatacggatcacatattaaataactgtatcactgttgaatttctcagatataataaaggcattgaggttatggagaaatacctggttcttaggaaatacatgctgaactcctgaatgggtgaagcagtctcaaacttactttccaatgattcatgggaaaaaatatgtaaatgtgtgtatttgtagagagagggtaagagaattacgcaaatgtaatacaatttacgtgaaaggcatacgtttgttgcattattctatctacttttctgtaagcatcaaattttttgaaataaaaaataagggaaaagggataatatttcactgtggtagaatcaaaagatttgatgaaacaacaatggaaacaaaagaattaaaacaggccgggggcagtggttcacgctcgtaatcccagcacttcgggaggccaaggcaggtggatcacctaaggtcaggagttcgagaccagcctggtcaacatggtgaaaccccgtctctactaaaaatacaaaagtcagccgggtgtggtggtaggtgcctgtaatcccagctactcaggaggctgaggcaggagaatcacttgaacccaggaggtagaggttgcagtgagccgagatagcaccactgcactccagcctgggtgacaagagccaacctctgtcttgaaaacaaaaaacaaaagaattgaaacaacagcttgggaaagtgacatgcatcagctgggagtgaaacttgcagcagtggcctcagtgcttgaatacaagccccaggccagtcactggccacagcaggtcagctggggctggcaggaagggccagagtagatgggtgttattcttccctcagatcactaagggaccaacatatttttctatcttaatttggctttccaagtcagctttccacgcagcagcaaagatttttcactgcagactcctaaatcaagtttctaatacaaatgagatttcccacaggccactggactctgtcctgtgcaaagagcaatccctcccaccccagctctacccccacaattagtttttctcagtttgggtgtaactgttgttagaaaccaagaattcaatttcagagaaaaaagatgacgtaaagtaagttgaagtctatatggttaaatgacttgaaaatgaccatataaactcatgaggctctttttttgaggtagggtcttgccctgtcgcccaggctggcgtgcagtggtgcgaccttggctcactgcaacctctgcttcccgggttaaagcaatcctcccacctcagcctcccacatcgtctgggactacagacacatgctaccatacctggctaatttttttgtacttttagtagagatggggattcgccatgttggccaggctggtctcaaactcctgggctcaagtgatctgcccacctcggcctcccaaagtgctgggattacaggcgtgagccaccacacccagctctcatgaggttttttgtttgtttaaaatatatcctagctctgtccactaaaaaggcctggaaacaataacaaactagtaacaatgtacagttctagtgcccagattttgatgtctaaataccagttcccactaaaaggaaccccaggactacttggagaaatggctgactccaggcctggggcaggaaatacgtaagatgagcccaagacatcttgtgtcagacagcaggaagctatcaaacagacaggtggaaaggagccagcttagaggaactcccaccgcccaaagaaggcacacttggagcatcaagagaaacaatggctgcaatttattgaaatacatgtaatatattacaaccatgaattcataatgatgcttttctggcaggacagtggctcacacctgtaatcctagcactttgggaggccgaggtgagaggatcacttgagcccaggattttgagatcagtttggccaacatggcaaaaccccatctctacaaaaaatttaaaaattagctgggcagctactcaggaggctgaggccagagaatcacttgaaccaggaggtggaggttgcagtgagccgagattgcgccactgcaccccagccggggcaacaagagtaaaactccatctcaaaaagaaagaaagaaaaaaaattagctcggcatggtggtatgtgcctgtggtcccagctactcaggaggctgaggcggaaggattgcttgagcacaggaggcccaggctgcagtgagccatgctcatgacacatgacaatgcactccaacctggagagaagagcaaaacttcatctcaaaaaaaataaaaaaacaaaaaaaaaacgggctgggcgaaatgactcacgcctgttatctcagcactttggaatccctaggtgggcagatcacttgaggtcaggagatcgaggccagcctggccaacatggtgaaaccccgtctctactataaatacaaaacaaattagccaagcataatggggcatgcctgtagtcccagctacttgggaggcagaggcaggagaatctcttcaacccaggagacagaggctgcagtgagccgagattgcgccactgcagtccagtgtgggtgactgagcgagactccatctcaaaaacacacacacacagaaaaaaaaaaagaaatttaaaaacatgatacttttctaaaaagctaaaaaactgggaaaagcatgtcatcactagctagtgaaccaactccttattctgaaaacatgtaaataaaagacaagaatgaagcattgatcctaactccatttcaaacccaatcgccctagttgttaagggaacgctcttctttacagaattccagctaacaaacatagaaggaatgacaaaatttgagaattactctaaactgcctaatgatactaattaaagcaatgatcagcagtggacattgaaagcactggaaaaagactgatgggaaactcagctatttgcaggatgacaaagtacacccctgtagattgttgctgatcagaagaggaaaaactgaacttcacaaaggagagattaggctgtaactgcttgaacccacacactaatcttagcatcactgtgagtgggacaacctgtacctcctgatacgatgcaatatgaaatacgagatatacaacatcatctatgtagtactctcaccaaatatgctcaacctaaatctaatacaaggctttagatctaacttcagtttagagaaattactagggatagagaaacaagatcaaaaaacaaacaaacaaaccaccatgagaaagcaatagaacaaatccagaaagtgggacactatttagaacaaatgatccagcctctcaacgagtgaataagaaacaataggggaagacacaactgttctggattaaaacagatttaagagattgcacaactcagctgggcatggtggctcacgcctgtaatctcaacactttgggaggctgaggtgggtggatcacttgaggtcaggagttcgagaccagcctgggcaacatagtgaaacacccccccatctctactaaaaatacaaaaattagccaggcatggtggcacatgcctgtaatcccagttactcaggaggctgaggcaggagaatcgctcaaacccaggaggcggaggttgcagtgaaccgagatcccaccattgcactccagcctgggcaacaagagcaaaactccatcttaaaaaaaaaaaaaaaaaaaggataatattctcttaagtaactacattactattgtcatgcctaacaaaaaattacatttgatttttatgtctgtaagtctgtttttttttgataacagctttattaaggtataattcgcataccacacaattcacccattgaaagtgtacaatttaacggcttttagtgtattcacagaattgtgcaacatctctttttgttgttgttgttttgagatggagtctcgctctgtcgcccaggctggagtgcaatggcgcaatctcggcacactgcaacttccacctcccagagtcaagtaattctcgtgcctcagcctccccagtagctgggaccataggcgcgtgccaccacgcccagctaatttttgtgtttttagtagagatggggtttcaccatgccggccaggctggtcttcaactcctgaccttaagtgatccaccagccttggcctcccaaagtgctgggattacaggcgtgagccacctctcccggcctgagaatattctcattttttaaaagatgcccgaagtatttaagagtgaaatgtcatgtctgggatttgccttaaaataaaaatggccaagaaattgcaattaaaactgttacgtccaagtgataggtatatggacattcattatagttttctctccagtcttatgtatctttgaaattcttcaaaataaagaattatgaaaaaatagcaattaccctttattttcagaatcacgagccaccattacaaatgttgcatccaaaacaggacaaaattcatcaccatgtaactgaagaacaaaggaaagaaaatgtacatatgagaaatggatttatcgggaagacctaccacgattctaacagacggtatgtatgctggccaggtgcagtcgctcacgcctataatcccagcactttgagaggccaaggtgggaggatcacttgaggccaggagtttgagaccagcctggccaatatggcaaaaccctgtctctactaaataatacaaaaattagcagggtgtggtggcgcatgcctctaacctcagctactcagtagactgaggcatgagaattgcttgaacccaggaggccaaggttgcagtgagccgagattgcaggcccctgtctaaaaaaaaaaaaagaaaaaaaaaaaagagagagagagagagagaaagcctgcaactggaaaaagaagagaagcactctcattaaccaccgtctgctaagggcctaccctgagccaggcacagcactaggctctcagaatggcaggatgacaaaggagcccgtggcctagcagaggagaaaaatacctcaaagtccaatcgggggctgggcatggtacctcatgcctataatcccagcattttgagaggcctagatgagaggattgcctgagaccaggaaagcgagatcagcctaggcaacatagcgagacctggtctctaactacaaataaaaattaaaaaattagccaggcatggtggtgcatgcctgtagtaccagctagtgggaagctgaggcaggaggatcccttgagcccaggagttcaaggatgcactgagctatgatcacgaccctgcactgtagcctggatgacagaaaacatcccatctccaaaacaaaacaaacaaaacgcaaatagtatactgcatgagatgggctgctggcatggagtttggaactgtgcaagactgggacccaaaggcaagggtcacagagagtatcatcagcgtttaatttgcctgctttcctcagaatctgagcttcttgcagggcgtgcctgtcctcctgatggcacacctacccagacggacctcccatcatgctcacaaacactagtatgtttcagggaactgtagtgtgccaaccactagcacagtttatgccttcatagctgggcacaggagctcccaagaagaggtaaaatcaaagatgattatgtgggttaagttaaatacaggttgagcatctctaatccaaaaataaaaaatactccaaaatccaaaacttttcaagcactgacatgacactcaaggaaatgctcattggagcatttcaagattttgaactctgggattaggaatgctcaaccagtaaatataaatattctgaaatcagaaacacttctggtcccaggcatttcaggtaaggaatactcaacctgtatttacaatgcataggcctctgaggttttaagatgtttctttttttctctccccaggaagagggtctcactctatcacccaggttggagtacagtggcatgatcatgtctcactgcagtctcgacctcatgggctcaagcaatcctcccacctcagcctcctgactagctgacaccataggcatgcaccaccacacccagctaatttttgtagagatggggttttccatgttacccaggctggtcttgacctcctgagctcaaggaatctaccagcctcagcctcccaaaatgctgggattacaggcatgagccaccatgcctgggccttaagatgtttctttatcccctagaagtctgtacttccaggaaagtcataccataaagtaatgacagaagttatttataacctgagagtatattgggttccctcctcaataaatgatacaagcctcatcactactgccctccccctcaattgcaggaacagtctcaccaatctcattatgcctctgccctattcaaacctttcaatagttcctcctttcttccaccagcacctgggctaatcctgttagcgtggcatataaagccctccacaacagagcccacgattgctccccagttgttcaccaaatactgtgctcatacctgcacctttttctctagccatagctaactaacaactgagaggtcctgggatagaacaggctgttgactgcctcctgtctatatctttacctgatgccttcctcagcagcctcattcttcacgacattcctcccctcccccatccctattccccagaccaagtttatctttgcctccttcattcagcccccttaatagaaacagtcctctcttgacagtggttctcaatgtaagagaagtagatgtcactctaataggcgggcatttgaaaaatacagagtggtttttgttgtcacataacttggggggcattactatggaggggggtaaccaaggagctaaatccctcacaatgcaggggatagacctgcagaacaatgaatgctcccaccagaaatgccaacagtgtccctgttgaaaaatactgcataacgatatactatatcataaccatttgtttatgtgactgtctccctactgcaccgtgagctcctgtaggacaaagaccattttcccccagttatatccctagtatttagcacaaagaccagcaaatagcagatacctgatcaatatttgccaatgaatgaaggaggcaggttctaggcactactagaatgtcaactccaagagaatggaactttatctgttttgctcactgctgtatgcctggcacaggacaggcactcaataaatgattgctaaatgaatgttaaatgaatggatgtcaggaagtgagctaggtgactcaaacccaggtcctatcgttgaggagtagagtccgcagtggaagagaaaagacatattcatgcacagctctgtaggagactagcaggtgccaggagagcaagtcaaagagacggtattgagggaggaggcctgaggaacaggtgttacatgctgggagaataaggaaaggattgagcatgaagttatcctggagcacagggagaaagaatgtggatacagagccagagcacgagaatttcaggcaaaagaaaaagcatcagcaattatactcattcactcactcccagttgaatatcccttatccaaaatgcttgggaccagaagtgttctgtattccagactattttggattttcgatttttggatttggaatgtttgcattcaatacttacaggttgaacattccaaacccaatgagcatttcctttgggcatcatgtcagtgctcaaagtcagattttggagcatttcagatttcagagttgcaatgctcaacctatgtaagttatggtttactatcatgaatacccactagtgccaagcactagaacgcaaacatgaataactccctattcttacgatgcttgaaggccagtggtgagcattaagaaggtatataaatgacaagtcaaagggaatatagttggaaaggtaggctggggctagtttatgaagccccttgggccctaattaatcaaaggagttttgttttttgtttgagatggggtctcactctgtcacccaggttggagtacagtggcgcaatctcggctcactgtaacctccacccccctgcctcaagcgatcctcccacctcagcctcccgagtggctgggatcacaggcgcacgccaccacaccagctaattttttgtacttttttttttgagaccgagtctcactctgtcgccgaggctggggtgcagtggcgctatctcggctcactgaaaactccatctcccaggttcaagcgattcttctgcctcagcctccgcagtagctgggactacgggcacgtggcaccacccccagctaatttttgtatttttagtagagatgggatatttcaccatattggccaggctggtctcaaactcctgaactcatgattcgcctgcctcggcctcccaaagtgttgggattacagacatggccaccacgcccagccagttttttgtactttttgtagagacggggtttcaccatgttgctcaggctggtcttgaactcctgagctcaggagatccacctgcctcggcctcccaaagtcctgagattggagccgtgagccactgcacctgggctagtcaaaggagtttagactttaatccagagataatgaatggtcactgaaggtttctgagaagggaagtgacctgattcaagatcagctttggaagacttatgtggtaaaaatgcataaaattaaaagagagaggtccggctagagaaagtcaggttaattaaaagacggttaaggcactcacacaagaggcagtgaggacttgaataaaacacagggccaaaaggatatggggagaaagaattctggtgagttgctgtgggtgatgaatttgcaagacctggcaaaaggctgcatgggaaaggaagcaggaggctggcaaagggaagactggaggaggatgagaattggggccaatcagtttggaacatactgtttattggaacttgaggtagcaacagcacgtctaggtggagaaatataaggagcactcaggaaagtgggtatgaaggtcaagcccaaaatagaaatttgaggccacctcaacagtatttataataaattaatattattgccaggctgggggcggcggcccacgcctataattccagcactttgggaggccgaggcaggcggatcacttgaggtcaggagttcgagaccagcctggccaagatggtgaaacccggtctgtataaaaaatacaaaaactagccacgcatggtggtgtgcacttgtaatctcagctactagggaggctgagacaggagaattgcttgaacccaggaggcagaggctgcagtgagccgagatcatgccactgcactccagcctgggtgacagaacaagaccctgtctcaaaaaaaaaaaaaaatttccaacagtggttactgtgtgataggcactgtaccaaagtacttcacatgaatgggtttttttcaaatttcccttaccacaaccatataacatggtactctgttactattttcatgttacatttgagaacacagaggctcagacaagtggtttatccacagccacatgactaggaagcagcagtgctgggattagaacctaaatctatgcaaaccagaggcagagtgcttatccccacaccacttctctggaataaaaaggatcactcgagtcatgagttattagtcaaatagccagtgaagaatgcaaatttaaaacaaaagtgtttacttgtctgacactgagttccactggttctctctcaataattcctgtatctctttttcaacctatttgtccaagaggcaaattgtcaagatgccctaaaaggcaggtcctgtgccaggaatctgctgtgcatggcactgagcagactaggaattaaccaagaatattttttaaaagactgtaggcagaacaggccgggcacggtggctcacgcctgtaatcccagcactttgggaggccgaggcaggcggatcatgaggtcaggagatcgagatcatcctggctaacacggtgaaaccccgtctgcactaaaaatacaaaaaaattagccgggcatggtggtaggcacctgtagtcccagctacttgggaggctgaggcaggagaatggcatgaacccaggagacggagcttgcagtgagccgagatcgcaccactgcactccagcctgggtgacagagcaagactccgtctcaaaaaaaaaaaaaaaaaaaaaaagactgtaggcagatcatagcagcaacccagcaatgttttgtttttaaaacagtattactggctgggcacggtggctcacgcctgaaatcccagcactttgggaggcgagggcgggtggatggcttgagtccaagagttcaagaccagcctgggcaacatggtaaaaccccgtctctactaaaaatacaaaaattagccaggcatggtgacacacatctgtagtcccagctacttgggaggctgaggcatgagaatcactggaacccgaggggcagaggtagcagaaagctgagatcgcgccactacactccagcctgggagacagagtgacactgtctcaaacaaacaaaataaaacagtattactgtcagttacatcaaacatgggaattgaaagattcaatcacttgcatatagtactgaataaaaaaaatacttattttgacaaataactactacagagctagcttcaggctttttctgaaagtgtgaaagtttatttcaccaaaaggtgaaatgcttcatcattccatagcaggaaaaaatgcatctgaataataggtctactgcagtggcccccaaccttttttgcaccagggaccagttttgtggtatacaatttttccacggaatggggtgggctgggggggatggttttgggatgaaactgctccgcctcagatcatcgggcactagattctcctaaggagtgtgcaacctagatccctcacatgcgcagctcacgatagggttcgtgctcctatgagaatctaatgccgctgctgatctgacaggaggcggagctcaggtggtaattctctcttgcccacagctcacctcctgctatgtagcccatggcccgggggttggggacccctggtctactcaataccctggcataaatgaataagtcatttttttttttttgagacggagtctcgctctgtcgcccaggctggagagcagtggtgtgatctcggctcactgcaagctccgcctcctgggttcacgccattctcctgcctcagcctcccatagctgggattacaggcacccgccaccacgcccggctaatttttttatttttagtagagacagggtttcaccgtgttagccaggatggtctcgatctcctgacctggtgatctgcccgccttggcctcccaaagtgctgggattacaggcgtgagccaccgcgcccagccagtcattcttaaataagttttccacaatgaaatcttggacatacactgaatcattttatttctgtgttgttatcctctttgaggtactttttcttgtcaaatttcttcaattgtttgtaatagctattctgagttttactcatcagattagctgttcctaactactgtaatagctcaaatgactgttaagggcccaactgtgtcccccaaaaagacatgtggaaatcctaacccccataactgtgaacgtgactgtatttggaaatagagtcgttgcagacataattagttaagatgaggtcatgccggagtagcgtgggcccttaatccagtatgattagcagcatcctgacaagagacaccagagagacagagacacatgagagaacaccatgtgatgacggaggcagagactgaatgaagtgctacagctggaagccaaggaacgctagggattgccagcaaaccaccagaagcaagaaacagacaaggaaggcttctctcttacaggttttagagggaacatgcctctgctgacaccttgattttggattcgtagcctccaaactgtgagtcaatacattttctgtttttatgccaccagtttatggtactttgtggtaccgctgccccttggaatccacgcaggattggttccagaactccctaccaccacccgccaataccaaaatccacagatgctcaactcccctatataaaatggggtcatatttacataaaacctatgcacctcctcctgtgtactttaaattatctctggattacttataatacctaatacaatataaatgccatataaatagttgttttaaggccagccatgcctgtaatcccagcatttggggaggctaaggtgggaggaccacatgaggccagaagttcaagaccagcctgggcaacatggtgaaactccatatccatttctctatttttatttatttatttatttattttttgagacgagtctcactctgttgcccaggctggagtgcagtggcgcaatctcagctcactgcaacctccacctcctgggttcaagcggttcccaaccctcagcctcctaagtagctgagattacaggcgtgcaccaccaagcctggctaatttttgtattttttaaatagagacagggtttcaccatattggccaggctggtctcaaactcctggcctcaagtgatctgcccacctcagcctcccaacgtggtgggattacaggcgtgagccactgcacccagccccatctctatttttttaaaaaaatggttgttatactgtattgtgttttatttatattatttttcactgtttttttccaaacattttcaatccatggttggttgaatctgtggatgtgaaatctacagacacagagggccaactgtacagcagtcctgggaaatgaatacagtaatcaattccattcactcctaccataacacagacttctgtgaaattctcctaggcagaaccagaaacaaacaccttaacatggacttgtatatgattagaaataaatattaaatataaacaccaaatagtacgtcaggctttgtccacaaggaggatattaataacccaccatccatatgacatgagctttcaactgtttttctagaagcagtgagcaacatacctgtctacagatacataggtaaataagcttttcttgcatggagactagctggttttacttaaacagtggacaatcttcaggcgcatatttacctggaacatttgcatcttcacttccatggatgtcttcccgacccagctaacatggccactgaacttaatgtcctgttctgggctcaagctcttcttacacatatctgcaaaacagaagtcaatcagggtccaagtcataccaaaaattttctgttctgtaaatatgaacaattagaaattatggcaaattccactacatttcttttttgtcttcaaaactaaaataacttttttgacacgcagaagaaatctacatgtgtttttgaaaaatgtagaaaaagcaaagaatataaaaaataaaactggaatcatgcaaaacccacctaattataataaatatcttggtatacagcattctagacattttcatatgcatatatacattaaaattccccataaagggctaggcacggtggctcatgcctgtaatcccagcactttgggaggccgaggcaggtggatcacctgaggtcaggagtttgagaccagcctggccgacatggtgtaatcccatctctactaaaaatacaaaaattagccgggcgtggtggcacatgcctgtaatctcagctactcgggaggctgaggcaggagaattgcttgaacctgggaggcgaaggttgcagtgagccaagatcgtgccattacactccggcctgggtgacaagagcaaaactccgtctcaaaaaaaaaaaaaattcccataaaaggagagtacgtcctgtaatctcaataatatcttgaaattactaagaattctaagtatgcatagaaaatgatatcacttaccaatcttatccaccagggctgtaactatcgataaaggagacatcttggcggagtggattttgttgtgcatgtaacaaataagaactgcagggaaacaggagtgtaccaaattttaaaaaggcagaattatttcccaacatttaaaatttcctccctgagatccatgaaaagccttgtctcgcttggaagatccagcccctaatattccattgatcatcttatcctaggatcaaacacttttataaattgaaggatttgggagatcctccaatctgactgccccctcaattttaagatttggtgaagaaatcaaagcccgaagcaagcccagacccaccagacagcttgttaccactccacagagactcagtgcccaaatcagagtaagaactcagcacatgagtctgacagtatcaaacatcttcaggaaagagaaacaaagcacaaggacttggctacctgttttcctcctggctttgtcctaattaatcatgaaacaattatttcactcagttatccctccttccccataacacccttgactcctataccaccctgtggttatctgtatactttccatattttaacaagcatttatatgtgccatgcatggttcatgcaccttacagatatcaactcatttaaagtcgtataattatacgttgggccgggcgcggcggctcagcctgtaatcccagcactttgggaggccaaggcaggcggatcacgaggtcgagagatcgagaccatcctggctgacatggtgaaaccccatgtctactaaaaatacaaaaattagccgggcgtggtggcgtcccagttactcaggaggctgaggcaggagaatcaattgaacccaggaggcagaggttgcagtgagccgagatcgtaccactgcactccagcctggcaacagagcaagactgtctcaaaaaaaaaaaaaaaaaaaaaaaagttgtatgattatatgttgattggctccctgcttcccccatgatccattcaaatttgtatcacaaactctcagacaagatatgtggctcaataaatacttgttgagtaagtgtaaatccttccatctatgcacctgctaaaggacacactgggggaatgataggctaaaggcaataaactccatttaaaagtctttgtccagcaaagaaatcagatggctccaacctatggcaacaggagtagaaatgaaaagactatgagttaagaagaaggtaaacctgagaagacttgaataaattcagttttctagcttgcataggtaagcgtggtgtactagtcactgaaaaagagaagagagactgggcacagtggctcatgcctgtaatcccaacacttttagaggcgaaggcaggaagatcacttgagcctaggagttcaagaccagcccaggcaacacagcagagactccatctctaccaaaaacacaaaagttagccaggtgtggtggcacatgcctgtagtcccagctactcgggagataggtaggaggattgcttgaacccaggaggtcaagactgtagttagccatgatcatgccgctacactccagcctgaacaacagagtaagactctgtctcaaaataaaaagagaatataggaagaaaagaatgggccattttcaatgcgttgaatttgaagagcctatggcacatccaaatgaaggtattggggagggcacagttgttcacacctgtaatcctagggctttgcaaggccatagcaggaggatcacgtgagcccagagcttgagactagcctgggcaacagagtgagacccctgtctctacaaaaaactttaaaaattaggccaggcatggtggatcaagcctgtaatcccagcactttggaagacagaggcagatggatcacttgagcccaggagttccagaccagcccaggcaacatggtgagatcccgtctctacagtaaaatacaaaaattagccaggcatggtggcgtgtgcctgtggtcccagctacttgagaggctaagatgggaggatgcttgagcccgagatgtcgaggatacagtgagtggtgatcgcaccactggactccaccctgggtgacagagcaagaccctattccaaaaaaacaaaacaaattagccaggcatggtgcagtgtgcctatagtcccagctactcaggaggctgaggcagaaggaacacttgagcccgcaagtttaaggttgcagtaggctatgattttaccactgcactacagcccgggcaacagagtgagactgtctctaaaaaagaaaaataaatctagtagctaagaggaaaaattgattgaaactcagaaaagcaggccagaaaatgtagctttgtaagtattcagcatactgatagcaactgaaacactgggagtagatgagtttatagagaatctgcaacgtcaacccaaaaaagggcagaagggaagggtagagaagagacggaggaaaatgtaatataaatgtagtttttaccactgatcagtacacttaaaaatgataaagatgagccaggcgcggtggctcacacctgtaatcccagcactttgggaggccgaggtggggggatcacctgaagtcacgagtttgagaccagcctgaccaacatggcaaaaccccatctctactaaagatacaaaaattagctgggcgttgtggtagatgcctgtaatcccagctacgtcgaaagctgaggcaggagaactgctcgaactcgagaggcagaggttacagtgagccgagatggtgccactgcactccagtctaggtgacagagtgagactctgtctcaaaaaaaaaaaaaaaaaaagataaagatggtaaattttatattttaacctcaactgaaaaaatagggctgggcgcagtggctcacacctgtaatcccaacactttgggaggccgaggtggggggatcccttgagtccagcagtttgggaccagcctgggcaacatggcagaccttgtctctactaaaaatcaaaaaaattagctgggcatggtggtgtgcacccgtagtcccagctactcaggaggctaaggcaggaggactgcttgagccaggaggtcaaggctacagtgagctgtgatcacgccactgcactccagcctgggtgacagagtgagaccctgtctcaaaaactaaataaataattttaaaagatttaacaattttattgttaaattttaaaatgccttaaaatttaattaatatgaacaaattataaaattcaaaaggccgggcgcagtggctcacgtctgtaatcccagcactttgggaggccgaggcgagtggatcacctgaggtcagaagttcgagaccagcccggccaacatggtgaaaccccgtctctactaaagatacaaaaaattagccgggcgtggtggtgtgtgcctgttatcccagctacatgggaggctgaggcaggagaatcccttgaacccgggagatggaggatgcagtgagctgagatagcgccattgcactccagcctgggcaacaagagcgaaactacagctcaaaaaaaataaataaacaaaataaaataaaataaattcaaaaaataatcagtttttgaaagggcagaagacaaaaccctggggataacctacatttaagggatcaacagaaaaagaggaacctacaaaggggactacaaaagagcagccagagaagcagaaggaaatgtcaccaaagcccaaggatgggctggacgatataagaagccacaaaggggtcaggtcagccctgaaaagtatccattcaactgtgcagtaaaggggccaatggcgagcttggcaagagcagattcaatggcgtggaggagcagaagccggaacacagccgaccgggaaatgtttaattaacaggaagttagcataaagaggcaatgagagcaggtgattttctaggttcttttcagaaagtgagctatgaagtaaggaagaaagtgtgaggtgttataaggaaagaggattttttacttatctttttttttttttttgactcagagcctcactctgtcacccaggctggaatgcagtggtgcgatctcagctcactgcagcctccacctcccgggttcaagccattctcctgcctcaacctcctgagtagttgggactacaggcacatgccactacacccggctaatttttgtgtttttgagacagagtctcgctctgttgtccaggctggagtctatctcagctcactgcaacctctgcctcccaggctcaagcgattctcgtgcctcagcctcccgagtagctgggattacaggcacgcaccaccacgcccggctactttttgtagttttagtagagacggggtttcaccatattgcccaggctggtctcgaactcctggcctcaagtgatccacccgcctcggcctcccaaactactgggattacaggcgtaagccaccctgcccggcctatttttcattttaagatggaagaaccttgaatatgtttataacttgagggaaaagtgaagttgagaaaaggctcaggaaatgagggagaaagccaagtgataaggcagttccttgaagaaatagaaggaatagaatcaagtgaacaggttaaagggactggccatcaacagaagttaatgagcaagaaagagggtagtggcaggggagtttgtatatataaggacacctaagcaaaccaaagtcaatcaggctgtagtgcagtggtgtcaccacagctcactgcagcctcgacttcctgggctgaagcaatcctcccacctcagtcttctgagtagctggaactactagtgcatgccaccatgcccagctaattttttgggttttgtagagatggggactcactatgtttcccaggctggtctcaaagtcttggcctcaagcgatcctcctgcctcgatctcccaaagtgcaaggattacaggtgtgagccactgtgcccagccaagaatttttaactgggtttatttaatctagagaaaagtagttgctaggcgtaagcttaacaacaagcttgtatctatattttaaaagttagggcctggcatggtggctcacacctgtaatcccagcactttgggaggccgaggcaggcagatcacctgaggtcaggagtttgagaccagactggccaacatggtgaaaccccgtctctactaaaaatacaaaaattagccagatgtgatggcgggtgcctgtaatcccagctgttcaggaggctgaggcaggagaatcgcctgaacccagaggcagaagatgcaatgagccaagatcggaccactctactccaggccgggcaacaagagtgagactctgtctcaaaaaaaaaaaaaaaggccaggcacggcggctcacacctgtaatcagaactttaggaggctgaggcaggaagatcctttgagcccaggagttcacgaaaaacctgggcaacacagggagaccccatctctataaaaaaatagttttttaaacaatatattagaaccctttttcagaccctttcccaaccattcagcccaaatatcattaggtgggagcaagtaaggtaacctagagtagggtgctggcatccaagcacggtgaggaggacatccttgcagagaggctgcaagagtgatggcagagcatgtcacagcttgagcacaatgaagagggtgagcctgcagagggggacctggtgtggggtaccagagcccaggtaaggtgaggggagcatccatgatgcatgaggggtggcagccataggaaattggtcacatacagcggaactgattaaataagtcaatatattaaggagaatggagccagttggagaagggaattacaaatatggaaaggaaggaaatgagaatgaaccccgtggtggctgaactggaattggagctatcagtgcgatcccatggttttcatacatacatctgtacaaagatttagaaataacatatatgtacgtatatgcacatatatttcccagctcctccactaagagggtatgggagcagtgatacccaggaataatgaccactcccaacgcacatatctccatttcaaaatatcatcctccacttcaaaatatcattctccatttcaaaaaagggctccttggagatgtgggtgattctaggactggggcagggaaaagcataagatgagcctagaatattttattgtgccagaaagtgagaaagtgctcaaagaataatggggacacatcaaagaaaaccacacagaagctagcctgaagggactgggacactcctgggatcatgtgaacatcaaatagatgatagtaacatattatagtccattcagtaacataggaattcctgagtccatactgatttaaaaataatgaattgaaagtctgatgaaggtctcaaagttacctgccacccccccccacataaggtacttattaattacaaaggggaaaagagtaactttacagtgaagaacagtggcagacatcatcgtcatccagtaagcaaagctgatatcatcagtaatgagacaaatcaaaaccatgcaccacttgataggatacaataagaacagagcatcccttctgtgacattcctgccagagatgcataacccaaagctaatcatgaggaagcaccacacagacccaaattgagggacaatacacaaaagaaccatgtcaaagtcacgaaagtcaaagaaagattaaggaactagtcctgacatgacaattaaatcaacatatgattcagaactggatccttctgctatgaaggaccactggcaaaagttgaatgggacctgaggattagacagtatgacacatcagtgttaatttcctgattttttatggttgttttgtagttatgtagaagaatgtccttgtttgtaggaaagacatattcaaatatttgggggtgatgtggcatcatgtcagccacttattctcacataattcagggacaaaaaatttttttcttttttatttttgagacggagtctcactctgtcgcccaggctggagtgcagtggcgcgatctcggctcaatgcaacctccacctcccaggttcaagtgattctcctgcctcagcctcctgaatagctgggactacaggcgtatgccaccacgcctggctaattttttgtatttttagtagagatggggtttcaccatgttagccaggatggtctcgatctcctgaccttgtgatctgcctgcctcagcctcccaaagtgctgggattataggcgtgagccaccgcgcctggccacagaaaaattctttatactgtatttgcaacttttctgtaagtttaagactttctttttttaaagttactagtaagaaagattattcagactatacctccattaaataggaatctacatttataagaaaaaaattatgacaattcagaagtagtagatgccattttttttttttttttttggagatggagtttcactcttgttacccaggctgtagtgcaatggcacgatctcagctcaccgcaacctctgcctcccaggttcaagtgattctcttgcctcagcctcccaagtagctgggattacggcgcccaccaacacaactggctaattttgtatttttagtagagacggggtttctccatgttggtcaggctggtctcaaactcccaacctcaagtgatccgcccgcctcagcctcccaaagtgctgggattacaggcatgagccaccacgcccggccgatgtccttctttttttgtgcactttagaatatcatcatctgtgcaggttaaagaataaaagagccctttccagtcacagaattcaatgtatatctgtaggtatctattagaaagactaaaataataccagtacctcccaagctgtcaagatcctcaagaatcctgccaaatctgtgaaataaagcaaacagtgaattaaatgcaaatcatgttggtctccctttaaaaataaataacacacttcagggtgatgaaaatgttctaaaattgactgtggtgatggatgcacaactctctaaatatatcaaaaccatggaactgtacactttaaacaggcgaattgtatggtgtgtgaattatatttcaaaattgttataaaacaaggaaataaaaacaaatacataaaaatagcactgtgttaccttacggtgttttgaacagtcaaatatttctctcgtaattcaggctcactgcccaaaggcaagagaacttcaatataactgtccttcattctcctaggaggcagtccatcctgtgatttagccaagaaactatgaagtaatttcctttcttccattgccttcacatggtctctgagaagaaaggatgcaggattcataaaacaagagcagttctagcccacaattccagtggtacacaggccagtaagataccatcaaaggaggaaaaagaaggtctgggcctactttcaccttctcttccttccctcccttcccacctgccacttggtgaaattgatcatttccggtatcatttctcaagcttaaaaacattcttaaggccaggtgcagtgtctcacgcctgtaatcccagcattttgggaggccaaggcgggtggatcacacgaggtcaggggttcaagaccagcctggccaacatggcaaaactccgtctctactaaaaatacaaaaaattagccaggtgtggtggtgggcacctgtaatcccagctacttggtaggctgaggcaggagaattgcttgaacgtgggaggcggaggttgcaatgagccaagatcacaccactgcactccagcctgggcaacagagcaagactgtctcaaaaaaaaaaaaaaaaaagaaaacttaaaactgatatagatatacccaaatgagccatatattcacccttatcaaaaagtttactcaaagaccagaatatttgaaattaaattaaaaatttagagagatggacaaaatagtatatatatatacatataaatatatatgctaaagaatggcttggccactctactttatattcccatttctcacctgacagttctcggattctttgagccccagttctctctctctctctgccttcaatttcaggaaagagagacagaggagggaaaatggactatatccaaaggaagtatggaaggcagaacaaaaggtaaagaagaacataacatgaaaaggagacagaaagggaagaaaaagaagagaagattaaggtgaaagagaaaagaaagacaaggggatacggaacgacaatgttgataagaacattagctaagatgtctttctaagcttaacttataaagtattatttccagaaatgtttaccctacaaaaactacaggagatagaggaatgagttaaatgacaccagtaaatccagaatgtggaacattctcaagacaaatggcttggcctccttaaagtcaagctcatgggggaagaataggggaaggacgactgtccattactctagattagggaagactaaagagtcataaccaccagatgcaacatgcaatcctttattggatcttgatgttttttaaacagctataaaaacatttttgttaaaaggagtaatctattacacaaaatggtaacagttgaggaaatgtgactatggatgagtaatatactagcaaggaattgctgtcaatttgattacatgagagaatgtcttatttgttggagataagcgaaggctggttttataaaatgtttactgaagatgcacgctgaagtgtcatggtgtctataatttacttagaaatggttcaggcaatatgtgtatattggaaaatttggcaaaatattaataagtatggaatccaggtggtgggtacacaggtattcattctttctaccttttagtaaagtgaaatttttcatataaagaatttaaaaataagtcattagataatttctataccaacaatagattattatatatctagtgatcactcgtgttttttctatctcattttagcctcaaaattatgtacaccaagagggatatgatcctactttacaacaaggaaatactgcgagaaagagaaagacaatatgggaggcctgactaattttgaactgacaagaagcaataaaggagtcaagttgcatgaaacagagaaacttagcgacttgggttcaagtcccaaaccctgacatttaatcattcaatctctgagtttcagtttcatgtgtaaaaaaaggaacaggaacatatgtcgtaagcacgtcacaagttttgttatgagaatcagtgaagtaatatacacctaaatgcactttgaaaatgcagaatatacgtaaatcatcttctttcatgacaatgaggtgtcatctgatgagtatgttgaaatgttgaccttctcccccaagcaaaatacttctcaacctatctctgaacatagggctccccatccccactgtgagaccatcaactgagcctaaatacagtgtagtataataccttggggatgaaaagaatgaatgaaaacaaagatgcatacctccagtttgtggatgctcctactatctcccgcaacttatctcgaactgaaacaaaaataaagaggtcattccatgaaacaaagaaatatgagaaacggattatggcaatgagctcaagaactacaaaaagcaattcatgcactcaaaagatttaaagatccatagatttccatttaatgccacaacaaacagctcagggacaggatcaagcctctgctccctaaaaacctgaaagaactatactgtctctttaaaggtgcacaaatgaatacctttgtgccaatcactagggtttatataaacaaacaaaaaaggataacttcaattattcacttaatggggctgtatcagtgttagccagtaagagccattatgatggagatatgaacaggattcccacctatcttcttttttgttgttttttttgagatggtctcactctgtcacccaggctagagttcggtggcacaatctcggctcactgcatcctccacctcccgggttcaggcgattctcctgcctcagtctcccaagtagctgggattacaggcgctgtgccaccacacccggctaatttttgtagttttgttttgttttgttttgtttgagacagagtttcgctcttgttgcccagcctggagtgcaatagcacgatctcagctcactgcaacctccgcctcccgggttcaagtgattctcctgcctcagcctcccgagtagctgggattgcaggcaggcatcaccatgccctgctaattttgtatttttagtagagatggggtttcactatgttggtcaggctggtcttgaactcctgacctcaggtgatccgcctgcctcggcctcccaaagtgctgggattacaggtgtgagccactgcgcctggcccccacctatcttcttatacgcagtaatagatcaaattacttagttcagagactaatactaatatccaaatctgagtctcattataattaatttctcatatatttatagtctcctggttgttagaaaagtttaagccagaaaaatgaagcaaagacttacatcaagctaaggcaaagaatgcaattttagttaatgccactgcccaaaagtgcaagcgtatattagtgcttacaaaatttaagctcttaaaagaaaagctgatactaattaccacacacaccatgattcacatgtatagatgaacatgctatatgaataaagggaaaatcaattagagaaccagcaataattcaaaactaaaagataaatctgtagtatttcaaatactgtgttgagtttatgtgtttttcctagcacttcaaaatatacattccagttataggaaattaactatagcaatcctcagtccttcaataactaactgatcaaaaccaaatataatttatatgaacatgcattttaactttcatgaaaaatggttgatttttctatcaaacaattttggatacaccataaatttgatgtataattacaactaaatgttagagaactgcaaacaacaaccattagtaacttagtcttatttctgattttttcctcctaagttccttgaataaaagaatggatggggccgaggtgggtgaatcatgaggtcaggagttcaagaccagcctggccaagatggtgaaaccccgtctctactaaaaatacaaagattagcctggcatggtgggcacctgtaatcccagctactcaggaggctgaggcagagaatcacttgaacctgggaggcggaggttgcagtgagccaagatcccaccactgcactccagcctatgcgacagagtgagacttcatctcaaaaaaaaaaaaaaaaaaaaaaggctcacacctgtaatcccagcactttgggaggccaagacaggcagattacttgaggccaggagttcaagaccagcctggccaacgtggcgaaactccatctctcctaaaaatacaaaaattagttgggcgtggtggagcatgcctgtaatcctagctactagggaggcagaggttgcagtgagccgagatcctgccactgcactccagcctgggtgacagagcaagactccatcccaaaaaaaaaaaaaaaaaaaaaaaaaaaaaagaatggacagaaagtacctcaaatagtacatggactactgatgctcactgacataaaataattactactagcttaatcagtgtaagaagagaggcaagtattgagggccaagaaggaaaaactttttaattttacttacatatatatttatatacacacataatataaatttatttggaccctttaaagaagccgcaattttaattataacgaatactcctagtttaataaagacaatccatagtttacgtatcatattggtaattgaaattaactttaattaagcatggactaacaggatccctcgaacataactatggactaggagtgtttacttgatacaactaatgggcccatctctttttttccatgccttcagaacctacacacaggaagtggaaatcacctaactaaaagagctcagtcctcaaggctcccaggaacaatagttcaaaatctgaatgtgacttctatctgaagctattaatattatgcagctatcctggtcattttgtcaatgaaatgtttatgaaagatctacctttaatatgcctcatttgctctaaactatcactctatatacctttcaaataaaagtaaaacaaggtttttcaccacataggcatcaaacagagacaccatgcttgccttcatgaatgtggaagattccctgtttcttggggttctggggtccttgagtcagtcctcttccaggagtaagctgccctttgcccaaggcacaaagcctataaaacaagataaaacacagagcagatcccacagcttcttccctggcaaccctaaagacctaccctcctcccagagtatctggccatatcacccttagtatatattgtcttgtaggagtctgtagctgtttcacaagtatatgtatgttttcatgaggctattccataaatcatctctcccactagagtaaacatttcttgagagcagagaccaattaggtaattatctacaaaataaataaaagacggcaactaggtttaatgcatttattattggtctttctattttattagtttcagaagtccataatcgatttagtaaacaactgagcaaactcattatgaacaatttattctgttctttattatcgcaccatatttcctcaataaataagataaacccaattataaagtaaactttgaaaattgaattagccctttccagatgcaaagaaagtatttatttaacttacgcagaaattttctagagtcccaacacaataaaataaaagctatctactggccacggtggcacaggcctgtaatcccagcactttgggaggctgaggcaggtagacaggttgagcccaggagttcaagaccagcctgggcaacatggcaaaaccccatctctacaaaaaatacaaaaattagccgggcgtggtggcatgcacctgtggtcccagctactcaagaggctcagatgggaggatcacttgaacccaggaggtcgaggctgcagtgagccaagattgtaccactgcactccagcctaggcaacagagtgagaccctgcttcaaaaaaataaaaaataaaagctgtctacctaaatgtgcctaacctactctcccaaaataagttgattttggttcattattgcttaagcattgactcctaatcacacaatattatgtcaggggtagcacacaggcaatatcacagattaataaactgatctgtgagagcacagttgaagaaggcaaggcactgaataggttaagaaccccgcaggccaggcgtggtggctcatgcctgtaatcccagcactttgagaagccaaggcaggtggatcacttgaggtcaggagttcgagaccagcctggccaacatggtgaaacactgtctgtactaaaaatccaaaaattagccgggtgtggtggcaggcacctgtaatcccagctacttgtgaggctgaggcaggagaatcgcttgaacccaggagatggaggttgcagtgagccgagaacacaccactatactccagcctgggcaacagagcaagactctgtctcaaaacaaaaacaaaaataaaacaaacaaacaaaaaaaacccagaaccccagatactgtcactcattccagttcaatttactagtaaattctcaccacctaatgtgggaataagcaatgactaacaacaaaaaaaagagatatttttagttttctttacagaccaagctactataggtttctcttctgaatgacagcattcagagaaagcctctcagtatttacagtattctgtaaaatctacatgcagttttgacactgtgctgttagaacaaatccttatcctttcaccaagtcaaatcatctaattgcacagaacacagaaatatgagcacatactcattggctaattgaacttcttagtcaccagtcatcttatttggttgcaatacaatccctgctggtccactaagaccaaaattcttgctggagggtttggggttttggatctgtttattcttcaatcacacagctaacaagcctctctcttaaatattttagcttcactttttcacgataaatattcaattcctgtactttcgtatacagattaatatttgtctttttttttttttttagacagagtctcgctctgtcgcccaggctggagtgcagtggtgcgatctcggctcactgcaagctctgcctcccgggttcacgccattctcctgcctcaacctcccgagtagctgggactacaggcgccgccaccgcgcccggctaattttttgtatttttagtagagacggggtttcatcatgttagccaggatggtctcaaactcctgaccctgtgatctgcccaccttggcctcccaaagtgctgggattacaggcatgagccaccgcacctggccgtctttttgtttttgaccatctaatctgcattttctcagaacgtgatttgaattttccatttttttcattattttgttttatgtatcttctataggttcatatgccttactgaaggaaacagagtaagtattccttcattcttccatctcagaaacaagcagccaggcatggtggctcatgcctgtaatcctaacactttgggaggctgaggtgggtagatcacctgaggtcaggagtccgagaccagcctggccaacatggtgaaaccctatctctattaaaaacataaaaattaaccaggcatggtggcgcacacctgtagtcccagctactctggaggctgaggcagaatcacttgaacccaggaggcagaggttgcagtgagctgaaatggccccattgcattccagcctgagcaacagagcaagactccatctcaaaaaagaaactagcattctacaactgaatatatctggttttaaagaacacactggaaaaagctaatcctttctattgctaccattagctgaaagagcaaaaaaatcatgacccccaacacattaataggaactataatagacacgttaaatgtatccaacataagaaatgggatctgattctgaatggctaaataccctgaatacgcatcactaacaggagctatataaccagtctcacatacctgaataaatacacatatacacagaaattgttttgttacactaagaagcagcattttctgaagagggatgaaaatcattccatcctgtttgtgtgagaggcaatacagtataggggttaacccaaaggctgggcgcagtggctcatgcctgtaatgccaacactttgggaggccgaggcaggcgtatcacttgaggttaggagtttgagaccagcctggccaatatggtgaaaccccgtctctactaaaaatatgaaaattagctgggcatgctggcgggcacctgcagtcccagctactcgggagtctgaggcaggagtattgcttcaacccaggaggcggaagctgcggtgagccgagatcgtgccactgcacagcgagactctgtctcaaaaaaaaaagagcccaatcatgctgcttgttagctgagttaccttagacaagttacctaacctccctgatcctcagtttcctcatctgtaaaatggggataataatactacctatcccataggattgtcaaaaggataaaggaattaacacatattaaaccctgaagggcacgtctagaagagcatgtctaatatactgacaagtcctcaaaaatctctagctatcattattccagaaagtcatgcttctccaaagtctcccctaaagatcaaaaagaaccaggctgggcacaatggctcacgcctgtaatcccagcactttgagaggccaacgcgggaggatcacttgagaccagtgtgggcaacatagggagatcccgtttctacaaaaaaattttaaaatattagtcaggcgtagtggtgcacacttgtggtcacagctactcaggaggctgaggtgggaggatcacttgagccccggggaggtcgaggctgcagtgagccatgatcgcaccactgcactccagcctgggtaaaagagcaagactctgtctccaaaaaaaaaggaaagatagcctaagccaggcactatcacggaccactgccaaacatagaatcaaatgaggagagaaaagaagggagttaatgaatacagagaaacacttgggccaatttatttggaaaattgtagtcctagagccccattgctttgcatgctgccttaaaaaatttggaaatacattcctgtggcacaacaaaggcataattggaacactttttaaaaaaatgttgcttataccaatagcatattggtaataataaatctatatcatactgtcaacatagcattcaagagtattcgggtaatggtaactttttttttttttgagacagtctcactgtcacccaggctggagtgcagtggcaacatcttggctcactgcaacctccacctcccgagttcaagcgattctccagcctcagcctcccgagcagctgggattacagctgtgcaccaccatgcccagctagtttttgtgtttttagtacagacagggcttcaccatgttgaccaggctggttttgaactcctgacctcaagtgatctgcccgcctcagtatcccaaagtgctgggattataggcgtgagccaccgcgcctggcatgtaatggtaacttttcactacatttggtatcctatttactgataatctgatggaaactgtggacctcgagcgggcgtgggaagggttggaatacatttttgctcacacacacaatggtatatactatttcaggaggtgcacagaccctttttgtaccctcagatccccctatatttgaagattctgattcaaaccaacctccttaagaaactgaggccccagtttcagacgactttcccccagtgccagtcaacaggcacaccagcagagtccagatagagcccagttcttccgatctcccccaatacatacacacacacacacacacacacacacacacacacacacacacacaccgcactgaggtggaggaggtgggagaatggttttaatcaatactcaacacttcagtacctcagggttactggcttatctcctgataagccctcaggagtcttacttatagcaaaacctctaggcctttactgtggagaggcctttgcaacactcaaatcccaggaccttgtaactgaacctttccaatcaaaggagatcaagaaactcaaggcggggggagtggggagggacagcattaggagatatacctaatgctaaatgacgagttaatgggtgcagcacaccagcatggcacatgtatacatatgtaactaacctgcacattgtgcacatgtaccctaaacttaaagtataataataataataataaaaagatgattattacaaaaagacaaaagataacaagtgttggtgaggatgtagagaaaagggaaccctcgtacactattggtgaaaatgtaaactggtacagccattttgaaaaataatgaggcagttcctccaaaaattaaaaatataactaccatatgatccagcaatttctcttctggacatatatcccaaagaaataaaaaaagtatttcaaagagaaaaaaaaaaaagaaaactcaaggcctccatggcctacctggggagtcacataactcaccctggctcagccctgggtcccaagcttacagcagttggcaaggaagagtgttcagtgcaataacaggcaataccactcatatgccctccactctgaggaaataacctctatttagagactaaacaaaggtgcctcttgcaagtctaaaaaagaaaagaagctacaaaggttgcccaccagtcaaagaacctaatcatctcagtctatattcatttgtgaactcctcctctcactagacactaagagattatccgcttaaggttcaatagttttttgtttgagacagaatctcactgtgttgcccaggctggagtgcaggggcgcgatctcagctcactgcaacctctgccttccggttcaggcgattctcctgcctcagcctccaaaagtagctgtgactacagacatgcaccaccactcccggctaatttttgtatttttaatagagacggggtttcaccatgttggccaggctggtctcgaactcctggcctcaagtgatccatccacctcagcatcccaaaacgctgggactgcagtcgtgcaccaccacacccggcctcaatagaattttcaagaaaggaacacagggttataagagaaagcacctgaacaagaccatggagcttttgtagaagacctttcacattgcaagctaaagtcaactgtggcccctctcataatgactttcagtctgccttcaaatagtttaacaaaggttttttgtttgtttttaagtactataaacaagacagaacccttacaactgataacaaagtccccaggaacagtgagtgagtgagagagagagagagagagagagggagagagagagagagagagatatccaggacccccaagagaattgatggggttaatgtgagtcaaaagcactatgagtcacatcagggggacaggcccactggcagcgagataacttcagaaactggagcaggtgtgagccccctgggatgcagccaggcagaaaacttggaaagggtggcatgctcgggtgaaagggattagggagagctagacacgctctggagtctaaggccctcaggccttaactgtgccagctgggaagattacatatacaaaaaggcatcctcccttacccacgtggcccaatcaaagcacccagcctcttataagggctttgcggctcattaaagttaagttcaaattggcaccagggtcctagacgcacagtcctagggtcctgggagccaaaaggtaccctgtaatctctgccaatgttacaacaaacttaagtaagagccgaagtaggtcaagcatttaatcctaaaaatgttctccaaaggaagatgaagggctagaggtaacatagaactccaaatattatctttctgacaaggggctaccccgacgcggctaccaaccacaccccggatgagcaaggccaaaggaattttagggaacacccaacttcctcccttaaaagtgctgctttgcttttaatatcaaactcagtgctagaagtcgccaaagtgggggcgaggttctcccaaccaaaggccggcgggcttatgtccggtcggaggtacagtgggcgagcgccccttatcatagagcccaaatgcccatgcgtggcccacttcttccgccggggccagcccgaagctctaggggaagacgatggcaccccaggctaccgccctgccagccccttccacgccccgccacctaccgcagtgctgcccgcctcattgcgctaggctgccgtgcgcgcgatggagaaccgggccccgcgcgctagtcggcggagggaaactgaggcgataaaagacgcacgagtaccagaccgcgcccttgctgaggacagcccgggagccggacagcggtgtccgggggcgggaccgcggcgtccagggggcgtggccgcgctgtgccgggcggaccctacccgttcattggcgggaggctggagtccgcctctgcggagcttcccactcaatcagttgtgcgggtcgtgttgctacagcgaggaccggcctattctcggttgagtaaacgaaccacgcagcaacgccagggcgtgacgtcgagaagaggcccggctctgcctagtggagcttgtctcctttatccttgatccccgcgccttggctccgtctgttcttccccttggctgcacattggaatctcctgggcaactttccaaaatactgatacttggccgggcgcggtggctcacgcctgtaattccagcactttggaaggcctaggcgggcagatcacctgaggtcaggagttcaagaccagcctggccaacatggcgaaaccctgtctctactaaaaattcaaaaattagccaggcgtggtggcagacgcctgtaatcccagctactcgggggacaggcacgagtatcgcttgaacctgggaggcggaggttgcggtgagccgagatcgcaccactacacttcagcttgggcgacagaaggagacaatgtctcaaaaaaaaaacaacaaaaaactgatgcttgagacccactggctggagattctagtttagtcctgggtgcggtctgggcttcgggatgatgtctaaagatgcccccaggtgatgctaatgtaaccaaaggctaaaaaccactgacctaacaggaaaaaattgttcctctcctcttctcggcctgacccccaatgtttgatatcttgggcgagctagagagattcaaggccagagagtttaagattatttcaccctacgatctaattctccatttctttcaacgaattattattgagctgtttgcattgtgccaggcactattgcagaggttggggttgcaaaaagaaaaaaggacaaaaatccccgcccttaaggggcttgcctcttgataaggaaggaaaacaaatcaacaaacaagttagcaaataacatgatctcaaatatggtaaagcggtttaaaggggaaataaggtaacgagtggggatcttttgagaatataagcaagtcttgctttgcctctaaatacggcaatttcctaaaaggcaagggccatatgctttttcgcaataccccatacttagtaaaaatgtattgatttgaattaagctagctttctgttttgaatcacttcatgagttacacatggagcatggtcttcggctttctctttctactgaattttccctgcttttatcaatctcacatctggaagactccccttttagcctacaaggatctctccttcatttttgttcacattgtcttttcatttttgtcacattgttcacattgttcacaagtcacttttcagtgattgtcttgttggttttgggtcagccatatttctttatactctaccacacctaacacagagggcaataaatattgtattgaattatgctatttttgttcttctttttacttgaacttttctttgaagcaataggaggctcagggagaaaaaataagtacaagagagaattttttgtaaatggtataataggtaggtacagtttatagtttttcccgcaatcaagtcgccttccgtcaatttccaaattataaagacacattctcatcaatataataaacaccatcgattttggctggaacagctgaaaccagggacttaatgccatgcagatgccttctctctattgcttatctttgctttcctttgcatactggcttcattcttttttctctctatgtaatgacattctccatatggcaatagaagctcctgaactttacatcttacaaccacagccacacacatacagactgactgaaatttctacggcccaaatacaaaaaagttctgagaagagattcattggtccaatttggatcaggtacacactcctggactagccaactgtggcatcagggtaaggaacccttgccctgacttaccaggaaccccctcacccagactcatggccaggtactgggtcacaatctactaacatggttatttctgtaagtaactgtacagatggggatacggagcaccttcttagaaaaggagtaccgaggccgggtgcggtggctcacgtctgtaatcccagaactttgggaggctgaggcgagtggatcaactgatgtcaggaattcaatactgggctggccaacatggtgagacccctgcctctactaaagatacaaaaattagctggctgtggtggtgggcgcctgtaatcccagctactcgggaggctgaggcaggagaatcgcttgaacctgggaggcgaaggttgcactgagctgagatcgcgccactgcactccagcctgggcaagagactccatctcaaaaaaaaaaaaaaaaaaaaagaaagaaagaaaagaagaggagtatggagcagccaaccacatagatgtccactagaaggttaaagagggaaaaaaatgatcacatcacttagcccacctaccttagttgtaacttcagggaacccctgctagacctagcctgcccagcattcatccacgagtctctaactacctcaattggcagcatgcataaaattcttaaaacagcttagcaactctgatttctgtgtgtgttgttgttgtcgtcattattatcaagcatatatgctataccacattttggatagcagagaaggaaggggaaatggtcacaaaatcaaaacaggaaacatacaacaattgtatagtggtgagaatcaccgtccttaagtaacaggttctctacccaacctttttgtttcctgttatgttctattagttctattttaatatggtctcaggataacagagatggtatcaattgtgtaattaaaagttacttaatcatgcactgacagatacataagatattaatgtcgttattacaagtaaaacaataaaatcaaataacaaggctggaaagcagtatcccagcactttgggaggctgaggtgggtggattgcttaagaacaggagctcaagaccagcctggtcaacagagcaagaccccatctctacaaaaaaaaaaaaaaattgtttaaatcaaacaacaaaacctaacaaggcattgtcaggtcttcttctttttttttttttttttttttttttgagacagagtctcgctctgttaccaggctggagtgcggtggtgcggtctcagctcactgcaacctccgcctcctgggttcaagcgattctcctgcctcagcctcccaagtagctgggattacaggcacgtgccaccacacccggctaatttttgtatttttagtagatatggggtttcaccatgttagccaggctggtcttgaactcctgacctcgtgatcctcccaccttggccttccaaagtgctgggattacaggcgtgagccaccgcgcccggccaaaggcattgttagttcaatctagtattatgagtgaaaaatatccagttaccatctttccttgggctgctgaataatatatacttttggatatctgatttaggtagaaaatgttcctggaaaactgtcatcaactttcaaacaaagtgattcgaactacgatttcattaggacacagaaactttttaaaaatatatcttatttcctcaattattcagattatacaaaaggatccacaataaagttaggaggggagggccaggcacggtggctcacgcctgtaatcctggcactttgaagctcgaggcaggcagatcacctgaggtcaggagttcaagaccagcctggccaacatggcaaaacccccatctctactaaaggtaaaaaaaatgagcagggcatgctgtcgcgcgtctgtactccctgctacttgggaggctgagtcaggagaattgcttgaacctgggaggcggaggttgcagtgagccgagatggtgccactgcactcaaagcctgagcgacagagggagactccatctcagaatataaataataatagtaataataaagtcaggaagggagaaggaaacaatgtaaaagtattttccagctgggcacagtggcttacgcctgtaatcccagcactttgggaggccgaggcggatggatcacgaggtcaggagttcgagaccagcctggccaatatggtgaaaccctgtctctataaaaaattcaaaattagctggccgtggtggcgcacacatgcagtaccagctgctcaggaggctgaggcaggagaatcgctcgaacccaggaagcggagattgcagcgagccgagatcgtgtcactgcactccagcctgggtgacagagtgagactccgtcccaaaaaaaaaataataaaaaaaagtatttttcaccctaacgttaaagaaaaaaacagaaagactagtgggctgttacgtgaatgtgcttagttttttgtttgtttttgttttttgttttttttttgagacagagtctcgctcttgttgcccaggctggagtgcagtggcccaatctcggctcactgcaacctccacctcctgagttcaagctattctactgcctcagcctcctgagtagcggggactacaggtgcctgccaccatgcctggctaatttttgtaattttgtggcccccagctccacttttatgactgctcttcaaatccaagtgttgaaaggttctcgtccacgaggctgaggcgggagaatcacttgaacccaaggaggcagaggttgcagtgaggtgagatcgcgccattgcactccagcctgggcaacagagacttcatctcaaaaaaaaaaaaaaaaagagagagcgagagaaaggttcgtgtctttagaaatgcttttccaggccgggcacggtggctcacacctttaatcctaacactttgggaggctgcagcaggtggatcacttgaggtcaggagttcaagaccagcctgaccaacatggtgaaaccctgtctctaccaaaaatccaaaaattagccgggcacggtggtgcacaactgtaatcccagctactcaggaggctgaggcaggagaattgcttgaacccgggtggcagagtttgcagtgagccgagaccacgccatttgcactccagcccaggcaaccagagcaaaactcagtctcaaaaaacaaacaaacaaaagaaatgcttttccctctaacaattttctcttgcttaaaaatggcaaacatggccaggcacggtggctcacgcctgtcattccagcactttgggaggccaaggagggcagatcacctgaggtccggagttcaagaccagcctggtcaacgtggtgaaaccccgtgtctgctaaaaatacaaaaattagccgggtgtggtggctcatgcctgtagtcccacctgctcgggcggctgaggcaggagaattggttgaatctgggaggcagaggttgcagtaagctgagatcgcaccactgcactccaacctgggggatgaagcaaaactccatctccaaaaaaaagaaagaaagaagaaggcaaacatttaaaacatataatactattattaacataggatcagagggcatctgtaagaacaggacatcttcatttcagggtatcaccttcaataaatctgtctctttcaataatataggggtacagagtcagatatacaaaaggtttattaggggcaacgcctataaaacataaaagggagagggaacaggaccagacaaggaacacctttagttcgtgatgtaggactaaaacctgagaaaggagaggggccaggaaagatatttgggtaggaggagccttggactgcagtgcagctctgagaaagcctaggcctgcaaaacagggagtgctggtgcaaagattgccctcccgaagagtcccatactggccagaaatggtgagcccttgtaccatggcagtgcctggcctttgcttagaggctgtctgggaagcatgtagcctcagcttgaaagctgaggcagatcttgacagctgtccgctaactccaccccttgtggcaggtctgctgtagggagatctgagtgggacacctccatggctaccacgggtcaccccctgcactgcacagatcgatttccccatacacattcagggaactcctccatggttcccatgggtctctcttcctgaagggaaacttagaagaggtaggttagtaggactaactacagtccctgtcactacagttggtattggagtcacagctggttctcatcctgtctttcctctaccatgtattctaaattcccctcacctctagctttcccaatggtgtaacccaaaccctcattcctgtgagatctgagcccctggtaatcatatccatttcacaccagagttgctgcacttgtccattcgcagtcacaaccaggcaagggaataccaagaagtgcccaactagattgatcacccaagtttcacacacattcctctctgccacgttgtacaacagcagcctcttcctgctgattgagagcaagtatccctgccaaggtgctgactccttggccacaagaagtccaaaggcctggccatacccacacttgtgtccactggcaagaatgtgcccctttgcagaacagaaccttgaactctgcagagcccacagttgcaaattcaggaaacatgagtgcccctgtgggccattagaaatgatagtaattggaggccgggtgcggtggctcaagcctgtaatcgcagcactttgggaggctgaggcaggcggatcacttgaggccaggagttcaagagtagccaggccaaagtggcgaaaccccgtctctactaaaaatacaaaaattagccaggcatggtggcacccgcctgtagtcccagccactcgggaagctgaggcatgagaatcacttgaactcgggaggcagaggttgcagtgagccgaaatcataccactgcactccagactgggcgacagagtgagactctgtctcaaaaaaaaaaaaaaaaaaaaaaaagaattctcttgctggccttgaagaaaaaagaagttatacaactgcaagaaaatgaattctgccaacaaccaagtgaacttagaagagagaccccagccccagctgacacatcgattccagccttggagaccctgaacagaggactcggctaagctatgcccagactcttgacccacagaaactgtaaggtaataaacatgtgttgtttatgccactaaatttgtgttaatttgttacctagcaatagaacatgaatacagtgcctatatttcatcctggaagatggtaccccatgcttgcagagtcttgtctccaagttggcacttcaattacaccttcagcagatcattcagatgctctgttaggatggctacttgtgaatgctgtggtatatgatatgaacgatgaatcctactggtcaggacctgctcccacacctccttcatgatgaagcaggtctcctcagatgccatcttgtgtgagaatccaggcctgtggatcaggcattccaaaagccccaggataatgatggtaaatgaagccctacaggtaggaaaggcagtcatactcagagaaaatactgattcctgtgagagcaaatctctggccctcctctggtgcggtggctcacgtctgtaatcccagcaatttgggaggccaaggcaggcggatcagttgaggccaggagttcaagaccagtttggccaacatggtgaaaccccatctctataaaaatacaaaaattagctgggcgtggtagcgtgtgcctgtaatcccagctactcaggaggctaagccaggagaattgcttgaacccaggaggtggaggttgcagtgaagcaagatcgggccgctgtactccagtctgggtggtagaggagattccatctcaataaataaataaataaataaatattttttaaaaaatcgctgacccttctaaagtaataggggtccaatgtcatcaacttgccaagtagcttgtgagtctccttgaagaagagtgccatgtcaggggacttggcattggtctctgatggcaggttggacattcaaaggtggcagtagccaggtgaagctcagtaagtgggagtccatgctgttgagcccatgaggcctgagaacctggggaaagcactggtgcaagtccctggagctgtgagtgtccctaacatctaattgcaaacacagcaggcattactgctcaaccagatacactgaagctctgtgcttgggggccaatcaccaagtcaacatgcagactgccagttcagaaaaaggacagcaagttagcaattaatgtaaatgtctactggattaaaaacccagttaaaaacaatattgctggccaggcacagtggctcatgcctgtaatcccaacactttgggaggccaaggcgagtggattacctgaggtcgggagttcaagaccagcctgaccaacatggagaaaccccatctctactaaaaataccaaattagccgggtgtggtgtcacatgcctgtaatcccagctactagagaggctgaggcaggtgaatcacttaaacccaggaggcggaggttgcagtgagccaagatcgcaccattgcactccagcctgggcaacaagagcaaaactcagtctcaaaaaaataagaaataaaaaaatattgctccataaacagttgcgcctagtagctcagactaccatcaagtccatttttaaaatgtggttttctcaggcaggcgcagtagctgatgcttataattccagaactttgagaggctgaggtgggtggatcacctgaggccaggaggtcaagaccagcctgaccaacatggcgaaaccccatctctaccaaaaatacaacaacaacaaaaaattagccaggcatggtggtgcacgctggtaatcccagctactcgggaggctgaggcatgaaaactgcttgaatccaggaggcagaggttgcagtgagcctagattgtgccactgcactccagcctgggcgacagagtgagactccttctcagaaaaaaaaaaaaaaagtggttttctgaaatgtcatgtaacattacctgattatctgaccccgcaccttctattatcatttgattgggggtggaggtgaggaaagaaatgggatcaagacatgaaacaacttcgctagactcagctcagagatgatacaaactttacatttcagagctctaagagacctggaaaactatcctattccttctctcctctcctcatatacaaatgtttttatcaatttttttacaacttttttaacaatgaggctgggcatggtggctcatacctataatcccaataatgtggaaggccaaggcgggaggatcacttgagcccaggagttcgagaccagcctgggccacataatgagacctcgtctctacaaaaaatacaaaaattagccaggcatggtggtgcacgcctgtggtcccagctacttcagaggctgagataggaggatcacttgagcccaggaggtccaagctgcagtgaactgtgatagcattccagcctgcatctcaaaagccaaacaatgtttttaacaaggaaaatatgacttagtgaacttaaaagacttgcctaaggccatagcggaagagcagaactataatccaaggctcctaaaagccagccaagacatttttcaaccccctacatcatctctcaaggactatgagtgtacacaacagcaatttgcatggctaagcacatgttatgagaaaagaggacatattttccaattggtaaatcaagctgcaacttttagaaaagaaagatacagtacaaaaagaaagaaaaaggaatcaaactttttacaataatcagttaagcaagtttttttatgatttgaggcagagatgaatcagaaaattccacactggtctccccactgactctgagtgctatttttatggaagtgacctaagatgcttatagtaatataataagagtcaaatgtttcctggcagccaatctagaaaaaagaatagaatataggaattggcaacaaccctataagaacaggttcaggctgggcgtggtggctcatgcctataatcccagcactttgggaggccaaagtgggatgatcactggagcctaggagtttgagaccagcctgggtaatatagtgagaccctgtctatacaaaataaaataaaatagctgggtgtggtggcgcatacctggggtcccaactacttgaaaggctgaggtgggaggatcacttgagcccagaaggttgaggctgcagtgatctgtgatcacaccactgcactccagcctgggcaacagagcgagactgtgtcaaaaaaaaaaaaaaaaaaaagaacaggttcagcaaacctgccccataaagtagaaatgcccttttgtaaccctttttccagaagctccccattctttagggcagttctctaggggtattcttgttattaaacatttttcttcacatggagctaatatctgcttcctggaactgcccctgatatgacacagaataagtctaagtctagtcccactttctttctttctttctttctttcttttaaatggagtcttgctctgttgcccaggctggagtgcagtggtgcgatctcggctcactgcaacctccgcctcctgggttcaagcgattctcctgcctcagcctcccgagtagctgggactacaagtgcatgccaccatgcccagctaattttttgtatttctcagtagagatggggtttcactgtgctagccaagatggtctccatctcctgacctcgtgatccacccgcctcggcctcccaaagtgctgggattacaggtgtgagccaccatgcccggcctagtcccactttcttgtgcaagccttcaagtttaactatttgccattttactcctttccttccattttcttgagttcaggttaaatgttgcttgttcattcaatgacacagtgtggtttgcagccctaaaccagagtagtagtcctccaaggctgtttcagacatgtattctgcaaacacgaatgcaggatgctgccatatgccattccacgtgcctgggggaggatgtccaccccaacattgtaatgagaaaaaataactccgcttctcagtccagacattgggtaaatgttagcagatgtgcagaacaggtgcatattattccataccctcccaccccaatcctctattccacggtcatctcaactccttgcctcccatggcacttgggagattgaggattgatcaatccctgattgttactgatgtctgatgcccagcctataactgacctcactacttacttcccttcacttgtgactaattatagaagcagttatatcaagcagggccagggtcaggaccagggtgtggcaagtgaggcatttgccttgaatgcaaatttgatttttctaatattccattgaaatattatttatcttgattattggggttttcacccctttaaattctgcacaggtgagtgtctcacttgcctattcttaatcttggccctgattcatggttggattgaccagtgagatcaagagccaagagcttggactaacgaagaggtcagagttcattttgagtgatagccctcctattcagctagaagacagatttatctgatttcccttacccctcccacacacaaagaaattgttggatttcatcagagcagggaccataggtccatatatcacctcccaccagagtgccagcccctgatgtacctttctgtcctgttccaggacttagatatctaactcgtgaaccactaggcaagaagaagtcagaatacaagaaaaatactgacagttgaaggcaccaatgttggaatcctccattgctgatgagtgggttagtcccaaggccttttggttaaaagtaatgaatttttcaagtgaaaggtaatagggctggttacatttgggttcagcaaagtcataaaagaatatcaccagaagcaaccctcactagtcggtttgttttgttgttgttgttgttgttgttgttttgagacggagttgcgctcttgttgcccaggctggagtggaatggcacaatctcggctcactgcaacctccggctcctgagttcaagcgattctcctgcttcggcctcccaagtagctgggaattgcaggcgcctgccaccaagcccagctaatttttgtatttttagtagagatggggttttaccatattggtcaggctggtctcgaactcctgacctcaagtgatccacacgcctcaaactcccaaagtgctgggattacaggtatcagccaccatgcgcgcccaggcactagttggtatttttaaaaggggttcctattgaatttctgtattgttgtttaacataattagtaaaaatctgccagggtaaaaattacaggattgggccaggcacagtatcttatgcctgtaatcccagcactttggggggccgaggtgggcagatcacttgaggtcaggagttcgagaccagcctggccaacaggatgaaaccccatctctactaaaaatacaaaacttagctaagtgtggtggcacacgcctgtagtcccagctatttgggaggctgaggcatgagaattgcttgaacctgagaggtagaggttgcagtgagccgagattgtgccactgcactccagcctaggtgacagagcaagattccgtccaaaaaaaaaaagtgaccaaataatagtatggatagtatggtttattgagcactaattccttaaataagcactaatcttatttaatactcacaacaactgtatgaggtcagtattaccatcttatagataaggaaattgtggtttagagacattaagtaactctccaaaaagtcaaatggccagcaattgatggctagcacacatttaccaaacattaggttggtgcaaaagtaattgcagtttttgccactgaaagtaatggcaaaaaaaaaaaaaaaaggaagtactggctattatcagatgtgtaattagttgtgtccttctccaccagagggcgcagtcctgcacccgagacttgtcacgaaaacccgataatggggtagatctgaaagtaggttcatgaccccagtcattgataacagcagtcactggtggaatcaggggactctgcagtcacaggactcaaacttggaaatgagacatcatctagaaacctagatgatcacagggcctcaaattgtagtattcaagttcccctttcatgtacatattcagcattttccaagccttcagacaagatttctcccttttggtttgtctccccatggggacaaatgtattctaatttatttttactctggtaaattataaagtaatgaatgacagatagttctaacttaattgacgggctccccaccatattgcaaataaaatgacttgaaaattgtcatctcagaagcctatgtctgcatttaatttttgtaatctaggactcttttccacctaaagccaataaataaggaaactgtatttccacttctttccactgtactttggcaaaaatagattctggacttcttactactatttcattgtgccctttcaggtggatgtgagtctgtgtcatttattggttacatccttacacatgtatcattcttacccatctcttagtcccgtctaccatggaaacagtaggtgatgacaggatggtaataagcatgaaattcaaaaccagaaaggtgagctgatgctggagctacagggtctttactatctgcaactggagtggaccatttctgctgtcttgtccttgatatgacactgacatgaagatacagtaagactgaaagtaaagattaggaaaaacgcttatcaggtaaatacttacaaaaataaagctgtattggctgggcacggtggctcactcctgtaatcccagcactttgggaggccgaggcaggaagatcacgaggtcaggaattcaagaccagcctggccaacatagtgaaaccccatctctactaaaaatacaaaaacttagtcgggcgtagtggcgggcgcctgtaatcccagctactcaagaggctgaggcaggagaatcgctggaacccgggaggcggaggttgcagtgagcggagatggcagcactacactccagtctgggcaacagtgtgagactccacctcaataaataaataaataaataaataaataaataaataaagctgtattaattagccagggtgatggtatgcgcctgtagtcccagctactcgggaggctaaggcagaggatcacttgtgcccaggagatcaaggctgcagtgagctgtgatcacaccactgcactccagcctgggtgacagagcaagaccctttctcaaaaaaataaataaataaataaacaataacatataaaatttaaaaatataaaactggctgggcgcggtggctcacgcctgtaatcccagcactttaggaggccaagatgagatcacctgaggtcaggagttcaagaccagcctggccaacatggtgaaaccccatctctactaaaaatacaaaataagccaggcatggtggcatgtgcctgtaatctcagctacttgagaggctgaggcaggagaatcgcttgaaccagggaggtggaggttgcagtgagctgagatcgtgccattgcactccagccagggcaaaaagagcaaaactccatctcaaaaaaaaaaatacataaataaaatagaacaaaataaataaaaaataaataatataaaaaaccactctaaagataaagaggcacaaacatgataaaaggaaaaattcaccatgaaaatattagtataaaaactttgaacttgcttgtacccaataacatagtctcagttaaaaatgcattgataaatttgactttttttttttgagacagggtctcactctattgcccaggttggagtgcagtggcactatcacagctcactgcatcctcaacttactggactcaaggaatcctcccacctcagcctgctgagtagctgggaccacatgtgtgcaccaccgtgcccaactaatttttttaatttttagtagagataggatctgccatgttgcccaggctggtctcaaactcctggactcaagggatcctcccacctcggccttccaagtgctgcgattacaggcatgagccactgcacctggccaaacttgactactttaaattgaaagacttccatgtgaccaaagacactattgacaaaaaagtatcctagccacagattcagtacatgtctgtaacaaaaatagcaaaaggggagggattagaataatgaattatataaaagggctactacaaatgcataagaaaaagaaaaacaagtcaatcaaaaatggacaaaagtcagcccagcatggtggctcacatctgtaatcccagcactttgggaggccaaagcaggcagatcacctgagctcaggagttcaagacgagcctggtcaacttggtgaaaccccatctctactaaaaatacaaaaaaattagccaggcgtggtggcgggtgcctgtaatcccagctactggggaggctgaggcaggagaatcacttgaacccgggaggcagaggtcgcagggagctgagatcacgccactacactccagcctgggcaacagaggaagactgtctcaaagaaaaaaaggacaaaagttataagttagcattttacagaagaagaaaaatatatggccaataaacatatgaaaagatcactatcacattaatcaaatttaaaccatgataagatgccatttcatacccatcagataagcaaaaccaaaaggtctgaaaatatcaactgttggtgataacaaagagcaccaagaattctcattcactgctagtacaggttgtaaattggtatgatcactttggagagcaagttagcaccatttcacaaagttgaatacgtgtataccctgtgacccagcactccagtcttaggtaaataccctataaattcttgcccccatacacaaggacatacacaagaatgttgtttcaaacaacattgtttgaaatggccaaagaaaagaaaaacaaggccaggcgcagtggctcacgcctggaatcccagccctttgggaggccgaggcaggcagattgcctgagctcaggagttcgaaaccagcctgagcaacatggtgaaaccccatctctactaaaaatacaaaaatttagccgggcctggtggcagacgcctgtaatcccagctacttgggaggctgaggcaggagaatcacttgaacccgggaggtggaggttgcagtgagctgagatcatgccactgcattccagcctgggcaacagagcgagactccatcaagaaagaaagaagaaagaaagagggaaggaaagaaagaaagtagaaagaaaaaaagaaagaaagaaagaaagaaagaaagaaagagagaaagaaagagagagagaaagaaagagggagggagggagggaggagaaagaaagagaaaacaaatctaaatgtccgtcaacaggaattttttttaactttgaatgctccaaggaatgatttttaatccaattaattcataatgcattgccaaatcagtttcaaggtcagtactccttccttggatagatttcaaatgcttgtaatttaatatttgcatcttgtatccctttcacatatatgaatacgtgtaaacactctaaataagggaaaggctaccctgagcagttggtgtcattaactggaaaaagctgtgtggctctttgtctcccacagtggctcacaggattgaaatgccttgttgagtttaccatggttcagatactggccctccgatatgctagtctgaaacttgatttgtcacttcactaaaggtaaatctgtgtgtgtaggaggactcacatttgccaagagactgatacatgaaattagaatatcaatttttttttttgagacagggtctctcacttggtcacccaggctcaagtacagtggtgcagtcatggctcactgcagcctcaacctcccaagctcaagcaatcctcccactttagcctcccaagtagctgggaccacaggtgcacaccaccatgcccagctaactttttaattttttttttgtagaggcgaggtctccctatgtggtccaggctggtctcgaactcctgtgctcaagtgatcctcacacctcagcctcctgggattacaggcctgagccaccacatctggcctcatttttttttttttttgagacggagtctcactctgtcacccaggctggagtgcaatggcgcaatctcagctcactgcaacctccacctcctgggttcaagtgattctcctgcctcagcttccggagtagctgggattataggtgcacaccaccatgctcggctaatttttatattttttagtagagacggggtttcaccatgttggtcaggctggtctcaaactcctatccttgtgatccacccgcctcagcctccctaagtgctggcattacaggcgtgagccaccacacccagcctttttttttttttttttttttttgagacagggtctcactctctcgcccagactggagtgcagtggtgcaatcttggctcaccacaacctccacttcctaggctcaagagattctcctgcctcagcctcccaagtagctgggattacaggcacatatcaccactacccggctagtttttgtatttttagtagagacggggtttcaccatgttgaccaggctggtctcgaacttctgacctcaaatgatccacccgcctcggcctcccaaagtgctgggattacagacatgagccaccacacccggcctggcctcaattttttaatttataatgagatgtgggtctgcttgagggtcatgagaagcccaattataactagaagatttattgatgaacatgaaatcagttgcattcagctaagatacattcacaagaatgtaaacaccatgatggtaaagatttgtctgatttttctactgttataattccagagattttaatagtacctgacacagtaaaaaaaatctgttaaacaaatgaatgaataaagacagactgatgtatctatctccacaatatacagatacctgaccgggcgcattggctcacacctgtaatcccagcactttgagaggccgaggtgggcggatcatgagggcaaaagatggagaccatcctggccaacatggtgaaaccccatctataatcccagctacttgggaggctgaggcaggagaattgcttgaaccagggagtcagaggttgcagtgagccaagatcgcgccactgcactccagcctggtgaaagagtgagactctgtctcaaaataaataaataaatataaatatatatatatatacagatccctgtctcaagattcagccactaaagttcttgcatcagggtattcttgtgcccactgcagtaccagcttgagtggtgccaatttgctaattttggcctttgaggttcttctttttctgtgtgtccaggactgaacctaataaaacctttagttgcctaccctaagccattcccttcttttttttttttttttttttttttttttttttttttttttttgagactgagtttcactctgttgcccaggctggagtacaatggcgcaatctcggctctctgcaacctccgcttcccgggttcaagtgattctcttgcctcagcctcttgagtagctaggattacaggcatacaccaccatgcctggctaaaatttttgtatttttagtagagacggggtttcaccatgttggccaggctggtctcaaactcctgacctcaggtgatccacctgcctcagcctcccaaagtcctgggattacaggcatgagccaccacgcccggctgccccactaattttttgtatttttagtatagacgaggtttcaccatgttggccaggctaattttgaactcctgacctcaagtgatccactcgcctcagcctcccaaagtgctaggattacaggtgtgagccactgtgcccggccacttctacaaaagttataaagcccataatacatgtccattactttcaccctagatagttaaatatcttttatagatgttaaaaacaagaaaaatatattttctatttacccacacatttgccatttctggtgctcttcattcctttgggcaaattcaagtgtccatctggtataattttccatcagtttgaacaacttcctttagcatttctcgtagtacagttttagtgatgaattctttcatctttagatttcctgaaatataaatccatttttgggttatgccttcatttttggagaacattttcactggatataaaattctaggctggcagtttttttcttttagctcattaaagatgtcattccaccatctctggtttgcattgtttttaatgagaaaccagtcatcagtctcatctttaaaattttctctcaatcaggccaggtgtgatggctcacgcccgtaatcccaacactttgggaggctagggtgggtggatcacttgaggtcaggagtccaagaccagcctggccaacatggtgaaaccctgtctccactaaaaatacaaaaattagccggtgatggtggcacatgcctgtagtcccagctcctcaggaggccgaggcaggagaatcgcttgagcctgggaggcagaggttgcagtgagccaagattgcaccactgcactccagcctgggtgacaaagcaagactccatctcaaaaaaaagaaaaagaaaaagaaaaagaatcactggttttcagaaatttgattctgaaatgccttgtagtttcctttgtgtttatgcagcttgggattcactggaattcttaaatgtgttaatttatagtcttcaataaatttggcacattccaaatgtagaataagaattacaaaattgagaattgtgttgcactaatatatattacagaaggtaaataaagagtgcttaactactattcacaggtccttaaatttgttttttgttttttggtttttggtttttttttgagatggaatcttgctctgttgcccaggctggagtgcagtggcatgatcttggctcattgcaagctccacctccagggttcatgccattctcctgtctcagcctcctgagtagctaggactgcaggtgcccgccaccacaccgggctaattttttttgtattttttagtagagacggggtttcaacgtgttagccaggatggtctcgatctcctgacctcatgatccgaccgcctcggcctcccaaagtgctgggattacaggcatgagccaccgcgcccagccctatttttgtttttaaccatggcttcagagactaggtactgaaagaaagtttgggaaaatttagcaacaaataggtttctgacattttttttaaaaaaggaaaaaaaatagaaagtctgggaaatggttatgtctgctgtcctgtccagattctaagtattataactgcataatctcctcctatccggtatctgtaaaatatctataaaaagaacaaagggccaggtacagtggctcacgcctgtaatctcagcactttgggaggccaaggcaggcggatcacttgaggtcaggagttcgagaccagcctggccaacatggtaaaaccctgtctctactaaaaatacaaaaattaggcaggcgtggtggtgcacacctgtaatcccagctacctgggaggctgaggcaggagaattgcttgaacccgggaggtggagtttatagtgacacaagatcgtgccactgtgctccagcctgggtgacagagcaagactctgtctcaaaaaaaaaaaaaaaaaagaacaaggaagaaaagttgtgtgaattgatatattctgaatcatggccttttgaaaattttctcctactttcatcttttctgtaagtttgcttctttaaaaaaaaatctccaagtgtagattatagttgaatgctatttaggtcctgaataaggtccacttctaaagtgagacagacttgtaaataatttacccagatgatgtgttctggattgaaccctgttcacaaggtgtctggccaggcagataaaatgctccaagcaaagtgcagtggggtttacaatactgattatccatactctaatgattcctgattctatgactattgagccatacctcattggttggcaaacaagaatcattacacatttattattcgtgaggaaggtcaatgcttcatgccaaaggtcaatgaataagagaatggtcctgtgtaagggcaggataaaacaactttagggcaccattaggccattcgcagctgttcttcctaacccaaaaatagttgggatccttatatcgccaggtagccagaaaggaacaaacatttagagggtgcctgttatattctaggcactctacaaagggctttacaacatcatttagtatttacaaccctaggaggaggaagctattattattcacttcattttacacataatcacactcaaattcaagtaccttgtctaaactcacacagctggtaactgggcagcacggacatttgcatctaaatgtgcctggccaaaaaaacaaaaaaaccctgctttttccaccacacaagtacacttagctccactttcctaaaaggactcactgagtcaactaccctttggcaccatggcaaaaggctggcattctctaagtcacttgcatggatgggaaaatccataatccctgtctgaggataagtgtgtattctatctatgaggcaagaacataaatgaagagatgtggaccatttttttaaaatgaaggcaagtttagtttgtttgtttttgtttttgttttattttgttttttagacagagtctcactctgtcacccaggctggggtacagtggcacaatctcggttcactgcaaccttcacctcccgggttcaagccattctcctgcctcagcctcctgagtagctgggattacaggcatgtgccaccacacccggcgaatttttgtatttttagtagagatggcatttcaccatgttgaccaggctggtcttgaactcctgacctcaagtgatctgcccacctccacctcccgaagtgttgggattacaggcatgagtcaccacacccagccgtgaaagcaagtctattaggaaagtaaaggaataaagaatggctactccacaggtagagcagccagtagaccattttcaaagcattgggacagctctcacctcagaaagaaatgatggtattgcggtgcctcagctctaccaactagattcaccaaccagtgagctctgcctcaatcatcgtagaatcaggaatcatcatctcggagtcattctgagatgattcatcatagaattgggaatcatctcagagtcattatcagagtctcagatcatcagtattataatccctattgcacttttcttgaagcattttaccttcctgaccggacaccatctgttcctgtgagtagaaaaatcctacggtctctgcaattctccttctgtgaagaggcctggatggaggcagcttcctgcagcctctcagggtggcagggatctcctagcaggttgattgtgtcacgggatccttcaggtgttgcttttccagctagaaagctctgtgaccagtggtgcctttgcctgagttttgatcaggcccgccagacttgttccactgacgtggcctggcaggctgtgctcagctcatgctaccagccaggattccacgcctgccgagggtgagccaggcacggaacagcgaggggtgtgcaggcgagcgaacgcagggtctggccactgcgcagagccggacacaccagctgctgcagctgggcaggcagctccaggcgccggcaaaggtgccggttctatgcaagtctgcagctggatctgatgaaccacaagcggcttctgctgtgggcacctgtgtctggacaaggggaatgcagtggtgcccggaagtttgaagataccagaaaccgcagagccccaaagagggtgtcacagccctggctcagggagcccctaggtctgtgctccctgaagggccacagcacttctctccttcacatcacccgcaacatggcaagtcgcgggggtgtggggacgggaggagggcgtgtttcagccctgtttgtgttactgctctttcagtcccgccattcagtgggtcctgagttctcgtcccacatccaggaagaatgaggtacgcggacaactagagggtgagcaaggcggagaggagccttatcgagtgacagaacagctctcgggaaacttgaagtgggtagctcctttccgcaggcaggttgtcccagtaagtgtccagctctcagtggagaagagacccagagtgggtagctcccttcttcaggcaggttgtcttgatgagtcgaggagacctgaattgggtagctccttcccacagctggtagtcccagcgtctgtgtgagtctggctaggctcagaagggaggaagtgcatgctgattggcccatgggtggccatgggctgacccggaaaaatcaccataagttctcactccgggccacagacttcacccgggactgacagcctagcccctgggcttcaggcctccctggcttgatggtggggctttaccggggacccacctctttccgcccaggagcctgtctgcctcctgccaccatcaatcatgtcatccacagcgcccaggctgttcctgcagaggagtaccggcagcccgcaccgagtgccctcagctcccccaccccacgccgccagcctctctcctgtgcttctcagtgcccaaagcctagagggggccagggtggcagggggctggcatgtcagcggcgccccaggcgcacgcacacccagctgggtctagacagcgcttggcctcagccacaactttgctccaccccagagtgggctccaggagcaaggagaggccaggcagcaggagcaggcacttccaagcctgcgggtcagggggtcttcccagcccccgagagcacagggatgtccaggtctgcagctgtggctgggtggttgcagctgtgccggaaagcgtggggctcccacccggccaactcagaagagggtggggctccggccagctccacggagcacgcagcccccaccgtgcctcccacactacagctggcatcttcacagtagccgctccagacaggccactgctgccatcaattgtttacttgtcttaaactgcaggtgttcataacccatattgcagagctctacttatcagtcctattcttgtgattggggacagggatgcaaagcagaggagaaaggcttacgaagaggaagaggttgaggagactggaactgtcaagagcactccctgtggtaattaaaacaagacgtgtgctagtgaaacttaatttgtaagaagtggactcaagtgttttgtttacagatttttgcccaagttccagccctaggagaatatttcatatgacatctgtttttttagagagaacaaattttttttttgagacggagtctcgctttgtcgcccaagctggagtgcagtggcgcgatctcggctcactgcaacctccgcctcctgggttcaagcgattctcccgcctcagcctcccgagtagctgggactacaggagcatgctacgacacccagctaattttttttgtatttttagtagagatggggtttcaccatgttggccatgatggtctcgatctctttttgttttgttttgttttgttttgttttgttttgtttttttgagacggagtcttgctctgtcgcccaggctggagtgcaatggcgcgatctcagctcactgcaacctctgcctcctgggttcaagccattctcctgcctcagcctcccgagtagctgggattacaggcgccgccaccatgcccggctaattttttgtatttttagtagagatgggatttcactatgttggcactatattggtcttgaactcctgacctcatgatctgcccacctcgcctcccaaagtgctgggactacaggcgtgagccaccgcacccggccacgtctgttttttttatttaccatttctgccagaaaatctatgagggtcataattgcacagtagtacagtaaaagatttcttgacttcaaagtcagtaaaccagccaggcatggtggctcacgcctgtaatcccagcactttggcaggcagaggcaggcagatcacttgaggtcaggagtttgggaccagcctggccaacatggcgaaaacccatctctactaaacacacaaaaaattacctggggatggtggcacgtgcctgtaatcccagctactaaggaggctgaggcaggagaattgcttgaacccgggagacagaggttgcagtgagctgagatcgcgccaccacactccagcctggcggacagagcaagactccatctcaaaaaaaaaaaaaagtcagtaaatctcagctgtatttctgactctctttcttttttaatgaggtttcttttttcttttcttttcttttcttttcttttctttttttttttttgagacggagttccgatcctattgcccaggctggagtgcaatggcgcgatctcggctcaccgcaacctccacctcccgggttcaagcgattctcctacctcagcctcctaagtagctgggattacaggcatgtgccactatgtccggctaattttttgtatttttagtagagacggggtttttccatgttggtcagcctggtctcgaactcccgacctcgggtgattcgtccgcctcggtctcccacagtgctgggattataggcatgagccactgcgcctggcctttttaatgaggtttctagtcaactatctgccactttctagctgggtgacctgggacaattactttaccttctctgggcttcagttttcttagcttttagatgaggaatgtggaatacagaattactttctatgcttctaagatgacagaaatctcaacaatagaggatgtaaggctttgaagaaaacccttatacttctagatcatattcatccagaccagttttatttaaacggctggttttattcctagttttccctgacgctctagaatggaaatgtacaattaatctctcctttttggagtacaacaaatattttctaatttaatagactccagataagaaagcaggacacacataaaaaataagtaacaacacatggtaattaagattaaatgaggccagggccgggcgcggtggctcacacctgtaatcccagcactttgggacaccgaggcgggaggatcacttggggtcagcagttcgagaccatactggccaacttggtgaaaccccgtctctactaaaaatacaaaaatcagccagctgtggtggtgcgcgcctgtaatcccagctactcaggaagctgaagcaggagaatcgcttgaacctgggaggcggaggttgcagtgagccgagatcgtgccactgcactctagcctgggcaacagagcgagactccatctcaaaaaaaaaaaaaaaaaaaaaaaaaaactaaatgaaatcacatttgtaaaatgccaaacaaggaataccactcacaataggcacaaagaaatggaagaaatgctggttgcatattttgttttccctctgctgtagtaccctcctataattaatctcataaggagaccctaaaatgtactacacttctctcagtcctatggctctgggtccccttttgatcttcttgcacccttcccctacctccatcatcctcccaaaaggaatgactcaccccaacatcctccaccttcagaatgagttttcaggtaataacttctgttgttgccagcagactatgccaaacattcacttgcaccagggccagaacattggtctgttccttgttcctcaggccagaggctgtttgggtgcagggtactctcgcgtttccttctttgaagcatcctctattttcctggattcactgttaacatttagttgccagttgacaaatggtacaaaggttggtaagctggattttgaactttaaaatctactgcatgtacccagaggccacagagaaaagagggggtgtcttatgctttgtgcactaacaggcaattatttactatgatcttcttactgagtaacctctatacctagattcaaagagctgatacttgtttgttgttgttgttgttgttttgagatggagtctcctaggctggagtgcagtggcaagatctcggctgactgcaacctccacctgctgggttcaagcaattctcctgcctcagcctcccgagtagctagaattacaggtgcctgctaccatgctcagctaaattttggtgggtttttttttttttttttttttttgagatggagtctcgctctgtcacccaggctggagagccatggtctcggctcactgcaagctcctcctcccaggttgaagtgattatcagcctccctagtagctgggattacaggtatgcaccactacacccagctaatttttgtgtttatagtggttacagggtttcgccatgttggccaggcttgtctccaactgacctcaagtgatccaccaacctgggcctcccaaagtgctgggattaaaggcgtgagccatggcgcccactcaaaagttgatactttaggaggcctaaggatggttgactgcacttttcagatatcctaagtatttataaggagttaaaggtttgatctctgagctgagtgataggcagtagtcttccttttagacacagtctcaggaggggagagaggaagggctgcccggaggaggtaggtcacacagaatgggttacaaatcatgtatctgccctcagttctaattgtacctgtcctttttctccagaaggctggatcctttcctaccagaaccagtaccttaagggcttgtaatattgaactgtgagtccccagagggcaggtactatgccatatttattttggcactccccaagcacaatgcttggtaggaaacagaccttaataagttttggctgtgccagacgtggtggctcaggcctgtaatcccagcatttttgggggccaagatgggcggatcacgtgaggccaggagtttgagaacatcctggccaacacagagaaatcctgtctcagccgggtacggtggctcacgcctgtaatcccagcactctgggaggccaaagcaggtatatcacctgaggtcaggagtgtgcgaccagcctggccaacatggtgaaaccccacctctactaaaaatacaaaaaattagccgggcgtggtggcaggtgcctgtaatcccagctactcaggcagctgaggcaggagaatcgctggaacctgggaggtggaggttgcagtgagccaagatcacgccactgcactccagcctgggcaacaagagcgaaactccatctcaaaaaaaaaaaaaaaaaagaaatcctgtctctaccaaaaaatacaaaaattatccaggtgtggtagcgcatgcctgtagtctcagcccaggtactcaggaggctgaggcaggagacttgcttgaacccgggaggcagaggttgcagtgagctgagatccgcgtcactgaactccagcctgggcgacagagcgagagccctgtctcaaaaagaaaagaagtattggttaaaggttgaattaaaagtaggcttttactgccctttaaatgtttggcatcagttctgggagccaggaaaaaataaataaataaataaataaataaataaataaataaataaatgtgtggctgacagactccatggtggccttcatgatcctgcctcctggtgttcatgcctttgtgtgataccttcccctcgagtggtgacaggacctgtgacttgattctgaccgatatggtataagtgataggatgttactcccatgattatgtcacatgatgtaagattctctcttggcaggaaacaaaagcaaaaaatagacaagtgggtctacatcaaacttaaaaacttttgtgcagctgggcgcggtggctcacgcctgtaatcccagcactttgggaggccaaggtaggtggatcacctgaggtcgggagttggagacaaacctgccaacatggtgaaaccctgtctgtacaaaaaatacaaaaagttagccaggcattgtggcgggcacctgtaatcccagctactcgggaggctgaggcaggagaatcgcttgaacctgggagttggaggttgcagtgagccgagatcacgccattgcactccagcctgggcaacaagagtgaaactcttgaaaattcatgaagggaggaaaatactcagtgaagggagtacagcataaccagcccagagaaagaaaccagaaagttcagtgcctcagtttcctcatctgtgaaatgtatcaaggagccagacctgagcccctctggggcagagactattattttcactcttatggccccagcatctagcagagtgtctctcacagagtcgcacttgttaaagcacttttttgttgttggtttttattgtttgtttttggcataggatctcactctgttgtccaggctcgagtgcagtggcatgatctcagctcagcaacctccgccccctgggttcaagcgattctcatgtcttcagccttctgagtacctgggactacagacacgtaccaccacgcccggctaatttttgtatttttagtagagacggggtttcaccatgttggccaggctgatctccaactcctgacctcaagtgatccgcccacctcggcctcccgaagtgctgggattacaagcgtgagccaccgcacccagctgataatgtgtgttttgacctgaccgtggtggcatatggacaagacggtttgggacttgtttatccaggaataaagttcatgttagcaagcagtgaatctccctcagtgatttgggctcagcttggaaccatcctgagaggcacattatttcttgcagactgcgcaattggggtcctctgaaaatgaaaccaaaatggaactcttgcttatgccacctgcttctgctgagggacacacagctctagtcgcctccagcacaagattcatgtggggcggtggtaatagtgacacttccaggtcacttagggaaatctctcgccaggagatgggcaactgggccattgatacagtggtacccggccacctttcatgagtgcctgtaattaaaatgacattttaatttggatttagatatatgataaagtgagacagaaagacaaataaacatgttttcctttaattttttggaaattttattagccccttataaaaggtttagtatgaaactagaaaattcaatttggataacttagtttctttttctctaatttagtttcatttctctttacacaaatgtcacttcctctctgtagctttccaggccactatgctgcctcgtcaccaagacttcgctagcactccatcctggcagaattaattgtttactgcttcctgtagatcatgtggcacattattcactgaagcagttatcacaatgtatttgattacatttctgtttttttttctctctaggtggcaaattctcagaagtcagaaactctccctgtttgatctttgtagtgtcaggacccagcataatacctgacatatagtagatgctcaataaatgaattaaatggaattgaattagtatattggctttacttattattttgtttgttttagtcccctcccccctttaatgattctttctttcttttttttttttttttattctcaattgttccatcacccaggctggagtgcagtggcacgatctcagctcactgcaacctccacctcctggcttcaagcaattcttgtgcctcagcctcccaagtaggtgagattacagggatgcgccaccatgcctggctaatttttgtatttttggtgaagacgagttttcaccatgttggccaggctggtctcaaacccctggccttaagtgatctgcccaacttagcctcccaaagtgctgggattacaggcatgagccactgcacccggcctgattattttcaaagaattgaagatagagtgcatcagaaaaaattctatattcattatctttactttctgttgctcagactatatgagcctcttggccaaataaaagccatttatggaactggtttgcagatgattctgaaaagaggctgagaggagagggattagggaggaaaaaaaatccttgtgggatagggtcagaattcaaagagaaaatggagaattaaagacaaattcaacggaattctaataagatcaggtgtagaatcataaacctgaggacaatctaggtatataaacgcaagacgtggaccaggcatggtggcccacacctgtaatcccagcacttttggaggccaaggtgggaggaacgcttgagcccaggaatttgagaccagcttgggcaacatagtgagaccctatctcttcaaaaagtaaaatattagctgggtatggtggcagatactttttctttttttttgagacgaactctcgctctgtctccaggctggagtgtagtggcatagtcttggctcactacaacctccacctcccaggttcaagctcttctcctgcctcagcctcccaagtagctgggacgacaggtgtgcaccatcacgcctggctaatttttgtgtttttagtagagatggggtttcaccatgttggccaggatggtctccatctcttgaccttgtgatctgcccgcctcagcctcttaaagtgctgggattacaggtgtgagccactgcgcccagccaggtggcacatacttacagtctcagctacatgggaggctgagttgagaagattgtttgagtccaggagttcaaggctgcagcgagctatgattgcacctctgcactccagccttggagacagagtgagaccctgactcaaaaaaaaaaaaaaaaaaaaaaaaaaggagtaaacccaaacccaagatgtgcaggagtggcatttcagaagctaagttctaggggtcatgtgatcctcctacctcagcctcccaagtagctgggactacagatatgtaccaccatgtccagctaatttttgtgttttttgtagaggtggggttttgccatgttgaccaggctggtctcaaactcctgggctcaagcaatccacccaactcgacctcccaaaatgctgggattacaggtgtgagccatggcgcccaccaagagctgacactttaggaggcctaaggatggttgactgcacttttcagatatcccaagtatttataaggagttaaaggcttgatctctgagctgagtgataggcagtagtcttccttttagacacagtctcaggaggggagagaggaagggctgcccggaggaggtaggtcacacagaatgggttacgaatcgtgtatctgccctcagttctaattgtacctgtcctttttctccagaaggctggatcctttcttaccagaaccagtaccttaagggcttgtaatattgaactgtgagtccccagagggcaggtactatgccatatttattttggcactccccaagtacaatgcttggtaggaaacaggccttaataagttttggctatgccagaagcggtggctcacgcctgtaatcccagcactttgggaggccgaggcaggtggatcacctgaggtcaggagttcaagaccaggctggccaacaaggtgaaaccccatctctactaaaatacaaaaactagccaggcatggtggcatgcgcctataatcctggctactcaggaggctgcggcaggagaattgcttgagcctgagaggcagaggttgcagtgagctaagatcgcaccactgcactccagcctgggcaacagagctagactccatctccaaaaaaaaaaaaaaaaaaaagcacccaaaacaacaaataacacaatttaaaaatggatgaaggaggctgggcacagtggctcacacctataatcccagcactttgggaggccgaggcaggtggatcacttgaggccagaagtttgagaccagcctggccaacatagctaaacccccttctttttaaaaaatacaaaaagttagccaggcattgtggcatgcacctataatcctagctaattgggaggcagaggtagaagaattgcttgtacctgggaggcagaggctgcagtgagccaagatcgcaccactgcactccagacagagcaagaccctgtctccaaaaagaaaaaaaaaatggatgaaagacttaaatagacagatctccaaagaaaatgtataaacggacaacaagcatataaaagacattcagcatcactaatcatcagagaaatgcaaattaaaaccacaatatcacctcacatctattttaactgccactattttttgaaaggtggccaggtgtggtggctcacgcctgtaatctcaacactttgggaggcctatgtaggaggattacttgagcctaggagttcaagaccagcctggccaagatagtgagacccccatctctacataaaaatacttttaaatttttttaaattaaagaaaggccaggcatggtagctcacacctgtaattccagtgctttgggaggctgaagtgggaggattgcctgagccctggagttcagggttcaatgagctaggatcatgccactgcactccatctagcctggatgacaaaccaagaccctgtcacttgaaaaaaaataataaaaaataaaaataaccagaaaacaaaatgacaactgctggtgtagatgtagagaaattggaacctttatgcactgttgggaatgtaaaacagtgcggctgctatggaaaacagcagggagattcctcaaaaagttaaaaatttaagtaacatgatccagcaatcccacttctgggtatatatccaaaaaaaaaaaaaaaatgaaaatagggccaggcgcggtagctcacgcctgtaatcccagcactttaggaggccgaggcaggcagatcacatgaggtcaggagttggagaccagccgggccaacatggtgaaaccccatctctactaaaaatacaaaaattaaccgggcctggtggcacatgcctgtaatccagctacttgggaggctgaggcacgagaatcgcttgaacctgggaagcggaggttgcagtgagccaagatcgcaccactgcactccagcctgggtgacagaatgagactatgtcaaaaaaaaaaaaagtgttcatggtagaatggtagagagcagtggcccttggtccaacaaagccagtcttaaatcataaacattcataactctatcatgtcccagctttaacaattttgtaacccctgttgagcctcaggttttgccagctgtaaagacagtgctattacttacttcacaagacagttgtaacggccaggcatggcagctcacacctgtcatcccagcactttgggaggctgaggcaggaggagtgcttgaagccaggagttcgaggctagcctaggcaacttagcaagatcccatccctacaaaaaaattttaaagattagccaggcatggcggcatgtgcctgtggtcctagccactcgggaggttgagatgggaggattgcttgagtccaggagttgtggttgcagtgagccatgcttgcattattgccctccagcttgggcaacagagcaagaccctgtttaaaaaaaaaatagggcctggtgtggtggctcacgcctgttatcctagcactttgggaggccgaggcaggaggatcccctgaggtcaggagttcgagatcagcctggccaacaggacgaaaccccgtctctactaaaattttaaagaaaaaaaaattggccgggtgcggtggctcacacctgtaatcccagcacattcagaggccgaggcaggtggatcacctgaggtcgggagtttgagactagcctgactgacatggagaatgcccgtctctactaagaatgcaaaattagccgggcgtggtggcacatgcctgtaatcccagttacttgggaggctgaggcaggagaattgcccgaacctgggaggcggaggttacggtgagccgagattgcgccattacactccagcctgggcaacaagagtgaaactgtctaaaaaataaaaaataaaaaaataattagctgggtgtggtggcacatgcctgtaatcccagctactcaggagggtgaggcaggagaatcacttgaacccagagggcggaggttgcagtaagccaagatcacaccactgcacttcagcatgggtgacaaagcaacactccctctcaaaaaaaaaaaaaaaatttaggctgggcatggtggctgacgcctgtaatcctagcactttggcaggccgaggctggtggatcacttgaggtcaggagttcaataccaccttggccaatatggtgaaaccccatctctactaaaaatacaaaaattagctgggtgtggtggctcattcctgtaatcccaggtgcttgggaggctgaggcaggagaatcacttgaacccaggaggcagaggttgcagtgagctgagatcatgccactgcactccagcctgggcaacagagcgagactccgtctcaaaaaaaaaaaaatagttgtaagaatcaaatgagacaattaaagcaaaccacctaagacaatgccttggctgattcccttcccagtactcttcccctactcagtcctcctcagttacagggattctctttctcacaaagattaaattctgctgtaaaaaccacacacacacatctccaaaagtaatgtgtataccctgagggctggtttcaaaacttggtcatcctttaaaacctccaagtacctagcacaagactcagtaaggacgtgttcatctgccgactcactaaccaaataaaagttttccaaatgctagacagttaatcccttttctcacgccattttttcccctgctgttcaggagctgtatatgccattttaaatataaattccatgctggacatgagatttctcatgcctgtaatcccagcactttgggaggctaaggcgtgagaatcccttgaagccaggagttcaaaaccagtctgggcaacacagaaggactcgtatctcattagccaggtattgtggcacacacctataatcctagctacttgggaggctgaggtgggagagtcccttgaccctgggaggtagagcttgcctgggtgacagagaaagactgtctcaaaaaaagaaagaaagaaagaaaagaaagactcccatctctacaaaaaattttaaagattagccgggcatggtggcacatacctgtggtccgagttactcaggaggttgaggtgggaggatcgcttaaacccaggagttcaaggctgcagtgagctataatcatgccactgcactcctgcctgggcgacagagcaagaccctgtctcttaaaaaaaaaaaaaaaaataggccaggcgcagtggttcacatctgtaatcccagcactttgggagaccgaggcgggcggatcacctgaggtcaggagtttgagaccagcctgaccaacatggagaaaccccacctctactaaaaatacaaaattagcagggcgtggtggcacatgcctgcaatcccagctactcaggaagctgaggcaggagaattgcttgaacctaggaggtggaggctacagtgagctgagatcacaccattgcactccagcctgggcaacaagagcaaaactccgtctcaaaaaataataatttttgtgttatatatatatacttgtatatatacgtatatatacacacatatatatgtgtatatatatgtatatatatatacctatatatgtgtatatatatgtatgtgtgtgtatatatatatggctgaacgtggtggctcacacctgcaatcccagcactttgggaggccaaagcgggtgaatcacctgaagtcaggagttcaagaccagcctggcccacatggtgaaaccccgtctctaccaaaagtataaaattagctgggcgtggtggcaggtgggaggctgaggcaggagaatcacttgaacccaggaggcggaggttgcagtgagccgagattgtgccattgcactccagcctgggcaatagagtgagactctgtttaaaaaaaaaaaaaaatatatatatatatatatatataatatatatatatatatgtaatgttggttgcatctatccattcatgacaatggaaaagcataatgtgattcactgccatgaaaaacattcaaacttcttagggttctaggcttcttcatgtccacaatcacagtcacagtgggcttttttagccgtctgttttgtttcggtttttttgagagagggtctcgctctgtcacccaggctggagtgcagtggcgcaatcatggctcactgcagcctcgacctcctgggctcaagtgatcctcccacctcagcctcccaagtataatagctgggatacaggcacacgccaccacacccagctaattcttgtattttttttgtacagacggagtttccctatgttacccaggatggtctcaaactcctgggctcaagcgattcatccacctcagcctcccaaagtgctgggtttacaggcatgagacaccacacctggccaccatctgtttttcagaataggttcttcttgtcataaggacaaagcaaagcaaaagatcatgaaacaatgttttttcttttttttttttttgagacggagtcttgccctgttgcccaggctggagtgcaatggcgccatctcggctcactgcaacctccgcctcctgggttcaaacgaatctcctgcctccgcctcctgagtagctgggattacaggcactcgtcaccatgcccaatttttttttaaattatttttagtagacacggcgttttaccatgttggccaggttggtctcgaactcctgacctcgtgatccacctgcctctgtagaaggagggatcagactatccccaaaagaccacccctcacattcaacaagtgattctctgcctttgctagcaatatcctgtatgtagaaaagaaagcagaagtagattctctgttacccttcctgccctagggggattccacggatcctgagtcaccctgggagattatgaaactcaaaggtctttctcaaagatctttaaaaaccactgattctcaactgccaaattacagctactagtctttcctgatagtgttggctagacctcatggatgaccagaaggccttttcctcctctgcttctgtctaaaatgtcaggacttaggagagcttgttatacatttcctggtaacagtaaattagaccgctatgactaagcgctagtgacagctgcgtagctaaagcaaaaccaaagccatcttctgtttgggttgcttagtttaatagaatagtgattgttttggccgggcacggtggctcacgcctgtaatcccagcactttgggaggccgaggtgggaggagcacttgagcccaggagttcgagaccagcctgggcaagatggtgaggccctatctctaccaaaaaaaaaaaaaaaaaaaaaaaaaaaaaaaaaaaaaaacttatcaaagaatccaaagaccttaccttcgaaaattgtaaaaaacagtaatacacaagcacatattcttttagtcaccagagcaatgacatcatcacatattctgtaaatgtataattatttcaaaaaaaagttaaaggaaatgaagcacagaagatgaatcaagtagggattacaacaactttcaacagcaaccgaagtcagaagacagataccatcaatgtgctgaaagaggaaaacttctgaacctcaaaatctataaactatgaaataaacccttcaagaattttaagatgggctggtccaaaggtagtgagttatctcagttgattgttcacaatcagttacacatcaaactccttattttactctgactactgcacttgactagtctaaaaaaagaattataagatgaattaaagacacgttcagataagcaaaactgagaacgtttggcaaaagcagatctttactaaaggaaattatgaagaatgtacctcgggcagaaggaaaagtgtcaagatcaagtgtcaaggaagattagagatttaagaaggtataagaaggttagaaaagtaagaaaaaaatatgccgtcaactctaaaaactacaagtataaagaaaaaagattattgggaaatccaaataacctaccttaggaaattctaaaagaatatacgagctcacattcctttggtcataagagcagtgtcatcattagacatcaggtcgcctctggaaaattccattgtgagtttaaaaggcaaatgacgtctataattctaaaactagttctcccaccgaaactctagaaaggatcttgggatctgcagggtctcccggatcacactttgagaactgctgctttagtcttcctcccatctcctaaggccagagctcctgagtttgcttcccactggccaaggagaaaagagcaaggtcacttgtcggggggctgcagagggaattaccttctttcatttgcaaatgttactgggggacacaccggctcccagtagggtttccgccaaggctccgcgaaacgccactagagggcgccgctagcgaatcccacagcgcgccccgctgcccccacttttgtcctccgggttcacacgggcgcccggaagagagggtggtgcctgggagaggaaacgatgcgccccggggccgcggcctcattggatgagaggtcccacctcacggcccgaggcggggcttctttgcgcttaaaagccgagccgggccaatgttcaaatgcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggtagcggagagccagagctcctcccggggcgtggggtggaggtggctccgtttcccagagtggggtgattcacgtcttgaggtctcggccggtgtgagagcccagcctgttcccctttctgcgcccatccccggctcggccgccaccccgcccgcccgccccattccgttcccctgagctggccgggccggagcctcattttgttttctacttttttctctcctatgtgcatccccccaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttggctggtccctgttgattggtcagaagacagctcagctaaaaggggaagttgtctgggtggttgctttttttctgacgtctgttcctcaggctggaagaaatgagcagaaaacaagggatgagtactttttagagtatgtgcatgttacgtaatacctgtttctgggcaatgctgcttcttctgactcaacaaatggggagagcaaattgaaaatgcgtaaattggaaggcaagttctgaaattaaacgttgtactttggcctgatgttctgacctttaaggaagcaagagtttgtaaacttccaaatatttactattctgaactgccgtgtaaacctgacgtattcccaagtcaacataccagtataccaataggatgtgaataatgtgtgtgttgagtttaaaaccatagcagttttgctctggcaagtaatgaaagcgttctcgcttcctgagtgtgagctccagcagactgcagagtggccagtccacagttgtagcctgacttcagtgagttctgatgtgtgctttttgcaaatacatgttctcagaacagtgagatcatccagcagtggcctggactgcactcacataaaaatcatgagacagccatggctacttgtttctgtaatacatgcatgtgtgttttttaaaacctatgataggcctctgattctgcagctgcaacttttatggaatgttttccttctccacatctcatgtgatgctcttattacaggacacagcattgttggttttgccatgtactattttacctatgacccgtggattggcaagttattgtatcttgaggacttcttcgtgatgagtgattatagaggtacgattgagttcggagcagagggtctgaagagagttcagagttataaatgcttacaatgactttttaaattgtactctttctttttaggctttggcataggatcagaaattctgaagaatctaagccaggtatgtcttagtttttggtttccaaatttgtaagtttactggattattttaatgatggaataaaaattgggtcttgagagcaggctgaaatgtcactgagtgtgtgttttactctctcataataggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaattgtttggtgtaagcatttttactagttctttatttcttacacatctttcttgctgttgaagacaaaaatgacccgcaaacatcattggatgaacagaattgctcaaaatagtttttaacccaatttaaagtttttatggtcatgtgttatgttagtattaacaaagtctggatagaagccagtttaccagttggctatcaaggttttatacatagcaacatgtaaaacatgacttttttttttttttgagacacagtctcattctgttgctcaggctggagcgcagtagtacgatctcagctcactgcaacgtctgcctcccgggttcaagcaattctcatgcctcagcctcctgaatagctgggactataggcatgtgccaccgtacccagctgatttttgtatttttagtaaagacggggctttgccatgttggccacgctggtcttgaactcctgacctcaagtgatccacccacctcagcctaccgaagtgctgggatgacaagggtcagccacagcacccggcaaaacggctttttatgttgatgacactatacactgcatctgatggatttttttttttttttttttgagacagtctcgctttgtcacccagcctgggcagtgtggagtgcagtggcacgatctcggctcactgcaagctcctcctcctgggttcacaccattctcctgcctcagcctcctgaatagctgggactacaggcgcccgccaccatgcccggctaattttttgtattttttagtagagacggggtttcactgtgttagccaggatggtctcgatctcttgacctcataatccgcctgcctcggcctcccaaagtgctgggattacaggcatgagccactgcgcctggcctgacggaattttcaagagctgaaaaccaagttagaaactgaggcccacaatgaataaacccatcattacacaagtaaaatgtggagatgggattatgaaacattgaaaatcaagaaaaaacatcttgtccctaaaaacctcatgccacataagatttttttttttaacagagccaaggtctcattcaatgaataaactcatcattacacaagtaaaatgtggaggtgggattatgaaacactgaaaatcaagaaagaacatcttgtcccccaaaacctcatgccacacaagactttttttttttttttttttttgaggaagagtcttgctctgtcacccaggctggagtgcggtggcacgatcttggctcactgcaagctccgcctcccgggttcacgccattcccctgcctcagcctcccgagtagctgggactacaggcacccgccaccacgcctggctaatttttttttttttttttttttttttagaggagacggggtttcaccgtgttagccaggatggtcttgatctcctgacctcgtgatccgcctgcctcggcctcccaaagtgctgggattacaggcgtgagccaccgtgcccagccaagactttttttttttttaatagagccaaggtcttactctttcgcccaggctgcagtgcagtggtgtgatcacagctcactgcagccttatcctcccgggttcaagcaattttcccacctcagcctcccaaaagtaactgggactacagctgcatgccaccatgcccagctaattttttttatttttagtagagacagggtcttgctaagttgcccaggctggtctcaggtcctcctgccttggcctcccaaagtgttgggattacaggtgtgagccatggcacctgaccaagataattttgaaggtaaagcggatcactgaaattagggtctcctatgtgtactgaaaaagtacacatttttttacaggaaatttgcaaacagaaaagctccagttggacacaagcataaatcagataaattaacatctcatttggagggtgaatttgtagtcctgtgttaatacaacggatttttagagcagagaaacaatagcccttaaaactgccagggggtaaagaagtaaacaagtgctttcttaaggactgaaatgaaaaagaaaaagaccatttccccctagatatgtgaactcctttcattattcatgacattggcccaaattcctaaaccgactaatttccacaataatgaaaacagtagttgataagaaccactgtagactaatgtccaagataaatgttttccaaaagaagtcagatacctgaaaacaatgctctgtatctctctgagttctccagcaaatcagtactgagctcctcagtcaaaggtaatgttgtcctgcaagcctttgtatcagtgtctgttatggcttcctagattagaaggcagccacatataaaaatgtagccctgtattatatttaatacaggagggctttgggatttattggtggctcagagagcatgccatgaaaatgggcttacagagtcaatgatcaaccaggggccctattaggcaggcaagtaactacataagagaaactctggcaaaaatgaaagggtaactaaacacaaagagccttgtggagaagtaagatattttgcaaattgtgttttggaaagtgagcctcttagaggaaaacaactacatgctgactgtggttaaatataggaataaattaaattaaccaccaagttacaatataactctttgtttcctcatctttcttagaacttagccttaaaggcccagtgttgtgaagatgaaggcttttatgaagttttgtatccactttaaagaagccccttaagtgtaaattttatttattttaatttttatttgtttttagttgttttcttttttttttttttcttgagacaggttctcactccattgcccaggctggagtgcagtggtgcaatcacaatttactgcaacctcgaccttctgggctccagcaatcctcccacctcagcatcccaagtagctagaccacaggaacgcaccaccacgcccagcttttcttttttttttttttaattttttgtagagatgaggtcttgctacatcacccaggctggtctccaactcctggcctcaaatgatcctcccccctcagcctcccaaagagctgggattacaggcatgagcctgcgcccagccagctgtaaaatttagaagctgaaacgccaactgggagcagtggctcacgcctgtaatcccaacactttgggaggccaaggcgggcagatcacgaggtcaggagttcgagaccagcatggccaatatagtgaaaccctgtctctactaaaaatacaaaaaattagcccggggtggtggcaggcccctgtaatcccagctactcaggaggctgaggcaggagaatcacttgaacccaggaggtggaggttgcagttagcagagattgcaccattgcactccagcctgggcaacagtgtgagactctgtctcaaaaaaaaaaaaaaaaagaagaagctgaaacaccacagcattagcccactactagctcaactcaattacaaagagacctctttaaaaactgaactataaagcaaatctataaagtttgaagtcaccaggcaagtaagaaaacatgttacggggaaattatctgaaaagaaacaacaaacaatgataaacatggaaaaccagagtccaagatcatcaaccgcttagattccacacagtagtctttctagggaaagaaagtagagtcttttttacagaaatgctgaagaagcaattcagaagaaacctaatgatttattaatgccttcgacccactctaccccttcctgtgagtctcctttccactggggacccagcagggcctagaatggatgatgctcatcacggttcactgaagcaggtggctgctcaccagcaactgatggaactgccaggccctgggaaaccagccaccttctcctgctaggagtgaagcaacttcctcactgactgtgacagccatggccttcctctgagtctgcaggtgaccatgtctgctcctagaattctatttccttgactggtgccatgtttgtttgtttgtttgtttgttttgagacagagtttcgcttttgttgctcaggctggagtgcagtggcgcgatctcggctcacgtgaacccgggaggtggaggttgcagtgagccgcgatcacgccactgcattccagcctgagcgacagggcaagattacgtctcaaaaaaaaaaaaaaaaaagaaaaagaaaaaaactagtgataagagctaacatttattaagcactaatcaggaaccaggctttcagtttagcactttgtatacattattatctcatctaattctcacaacgactgtatgagattggtacaattataagtttctttttacaatgagaaactaaacctaagagaagttaagttgcccaaggccacacaactagacctgggaatcaagctccaaaccaatttctcaaacccctggggcttcctgccatagtctcacaggacctcacagtttctataagaatgattgaatatggtgtttctgtgtgattctactgcaaagaataatcagtataagcattttctggataatcaaaagcagtgattctcagtatgggctacacattagaatggcctagaaagcactgtaaaaatactaatgccccatcctgagagagatttcttttttttttttttttgagatggagtctcactctgtcccccaggctggagtgtagtggcgtgatcttggctcactgcaagctccgcctcccgggttcacgccattctcctgcctcagcctcccgagtagctgggactacaggcgcccaccaccacacctggctaattttttgtatttttagtagagacgaggtttcaccgtgttagccaggatggtcttgatctcctgacctcgtgatccgcccgtctcggcctcccaaagtgctgagattacaggcatgagccaccgcgcccggcccaagagatttctaatttacttctgtttttatgcatataccaaagtgatgccaggggcccagtgcagcagctcacgcctgtcatcccagcactttgggaggccgagacagatagatcacttgaggttgggagttcaagaccagcctggccaacatggtgaaatcctgcctctacaaaaaatacaaaaattagccaggcgtggtggcatgcacctgtaaacccagctacttgggaggctgagacatgagaatcgcttgaacctgggaggtggaatttgcagtgagccgagatcacaccacgcactcccagcctgggcaacagagtgagactctgtctccaaaaaaaaaaaaaaaaaaaagtgatgtcagggttgagacccactgatatctggataagcagcttgcagcttataactgaatcttagtcacaattgttagtacaaccatttcagtttgtgtttatgctgttcaccttggctcttgccaagcaaaaccaagtgaagtcatatcacagtgcctaaagacgaaccttctcaaaagtttttggaaaacaaggcagaattgtcatctcactccatacagtgctgaaatcaaagaatatccacccaagcagtcagtaccatgttcctttgcaagcagcaacttcattacagaaaaacatcttccatcgcattaaatcagcattgttcatgtgaatgttattagtttggtaattttgtttgtattatatttataaatggatactggttttacagttatagaggagcagtaaacacaaaatattcacatctagtgtataattatagtaataaaaataatttcaaacaccactgagggtctgtgagaattttttttttttctatttttttgagacagagtcttgctctgtcgcccaggctggagtgcagtggtgcgatctccgctcactgcaacctccaactccctggttcaagcgattcccctgcctcagcctcccgagtagctgggattacaggcatacgccaccacgcctggctaatttttttgtatttttagtagagatggggtttcaccatgttggccagactagtctcaaactcctgacctcaggcaatctgcccgcctcagcctcccaaagtgctgggattacaggcgtgagccaccgtgcccggccggataattctttttcttttaaaaggagtctgtgttactcaagtttgaaaaatcctgctatgaccagtatacaatactgcctgcttttgttaggttaaaaaaaaagtgccaaaggcattagagataagacttgatcagattcaagtttgagttttgggcaagaatatttcataggtgatgtttttcccctcaagaagcaaataatgcctggtcttctctgtgctgctagccgttgttaatagcaatactcaggtctgctgattcattaggacttgcaaaatggtgacattctatcattccttctttatttatcacctagaatacttctataaagagaacttccacccaggtgctgtggctcacacctgtaatcctagcactttgggaggccgaggtgggagggtcatttgagcccaggagttcaagaccggcctgagcaacataatgagaccccgtctctataaaaaataattattattattaaaataagataactttcccccatcttacattttgttaccttgaggtacacagttcacccagaagaggcagaataaatgcttaattactcccttttatttactagttttcaaaagaatgaatttagtgccccccagcatcttccaattaggcttttttcctttcaagtagcattattatgttttaaaataatatacagatggggtttcaccaagttgcctatgctggtcttggactcctgagctcaagcaattctctcgcctcagcctcccaaagtgctgggattccaggcatgagccaccgcgcccagcctgaagtatcattattaactcaaggactcttagcatttcctgtgtcttaattacttgccatttttttcttattgaagctcagatttccctaattgtccagtgaaagcttcttcaagttggctccagaattgagtcctttggactcgaccccagaagcctttgttaacttcttcccttttaagttgtcccaggctcatctagtacatttcctcccccagacctgacatcaatggctaggtaattctgagcttcagcggttcccaggggaaacaacatttattgggagcaggtggtgttcacagttctctgttttgataataacacaggcacagcagggagatccttttaaaagtggggcttgagagtggcggcattcactccaggctttcctgaggaagtgttccaccagctgtgggccaacactgtcttcttccacctcagtgtttgtttatactgctttcttttatccagtgaatcaataacaacagcaacaataaaaatggcttcaaaacagctacatccacaacaacaaatctgtttgcagagacgtggtccagaggcagtttgggtctggtgaacacttgacttggagtcagaggaaattgaattagattctggcttttcttcatttatgagaataaaaacaaacttcatcttttttttaatttattttttattttttgagacggagtctcactctgtcgcccaggctggagtgcagtggcgcgatctcggctcactgcaagctccacctcccgggttcacgccattctcctgcctcagcctcccaagtagctgggactacatgcgcccgccaccacacccggctaatgttttgtagttttagtagggatggggtttcactgtgttagccaggatggtctcgatctcctgacctcgtgatgtgcccgcctcagcctcccaaagtgctgggatttttttttttttttttttttttgagacagagtctcactctgtcacccaggatggagtgcaatggcgtgatctcggctcactgtaacctctgcctcctgggttcaagcgattctcctgtctcagcctcctgagtagctgggattacagacatgtgccaccatgcctaactactttttttgtatttttagtaaagacagggtttcgccatgttggccagactggtctcaaactcctgacctcaggtgatccacccacctcggcctcccaaagtgctgggattacaggcgtgagccactgtgcctggcagatatacattattaatatattctatgtgacatatttatagtaacactacactgagcatctactatgtgccagacattgtggttttatttcatgaatgcccataacaatattgtagggtattccagtggtatgctagtaagtcagctggaggtggggtatccttgatttgtagaactggctgatttccatggtgtgaatacatccgctaagggtgtaccaaaggttttagcaactggctgacaaaattcctgaatatttaacaataggttctcccaagccagaaggagcaggttgcagcacaccactggatcaggcccatcttattttattgcattttattttattgagacagggtcttgttctctcacccaggctgcaatgcagtggtgtgatcgcagctcactgcagcctcaacctcccaggctcaattaatcttctcaccttagtctcctgagtagctgaaaccacaagtgcatgccaccaaactcctggctaatttttgtatttttttggcagagacgggtcttgccatgttgcccaggctggtcttaaactcctgggctcaagtgatccactggcctcggcctcccaaagtgctgggattaagggcgtgagccaccatgcccagcacaaatcaatttattttatgtcatacaaccaggaggcaacaggattgagatctgaactgggtagccgggttgcacatatacctcacgaactacaactcatggtctagtctcactaaccattcatggtagtgtttcctcattaaacactggtggtgctttagggctaagactgtttctttgaaacctggaaaaggtcttgcctgtgcttagattcggtgtcgaggaacagggagaatgcagtcttcctgtccactgttccctgtctcaacacgtctctgccagctctgcaagaaaattcgacacttccacaaaagaccagtgaaggaagccaacatgtttcaccccaaaacatacttctttgacgtatttcaagatggctattcagaagggctggaaatacgagaatagctgcaaagctgccttttgtggagctttgtatgtgtagagaaaatccgcattgatgcagccctgctttctcggaggccctcccttgtccggatctaggaaagattgactgagagtctgacgcctttggaggcctttggaggcctgaaaaagggctaccacttgtgaggtttgatctacataacaagacccactttgctagccaggcctcctcttctccccctaaacaggttagaagaggacttctcctccaacctgttttgccaggatccaagccccattcttttatttttatttattaattttattttgagacggagtctagctctgtcgccaggctggagtgcagtggcgtgatctcggctcactgcagcctccacctcccaggttcaagcgattctcctgcctcagtctcccgagtagctgggattacaggtgcccgccaccacacccagctaccaagccccattctttctgtaacctcaagatggtatataaacctctgtaccccctggaggatgggttgcagtaatcactctgtgatttccctccgtgaacattgataaatttgtatgccatttcttctactaatctgccttttgtcagttgatattccagtgaaccgtcagaaggcgaagggaaagatttcccttggcctccacagcagatttgaggcaaggcaagtgtttgagacggagtttcgctcttgttgcccaggctggagtgcaatggcgcaatctcggctcatggcaacctccgcctcccgggttcaagccattctcctgcctcagcctccggagtagctgggattacaggcatgcaccacctcgcccggctaattttgtatttttagtagagatggggtttctccatgttggtcaggctggtctcgaactcctggcctcaagtgacccaacctgccttggcctcccaaaatgctgggattacaggcatgagccaccatgcctggccaaattacgtttgagttctgttgctagaaacaaaaatgtgctctcctgaattttccacacaggcctccaaggagttaaaagacaaaaatcattttccagtttctctggcttcaagcctgattcccagacgggatccaacactaatcgccatccaaatgcctgtcagcaagatagtcatgatgtactctggcatatagtactgaggcagtcttgggcaatgttgttatagaattatgttataattatactcggccttgtttcctgcacatctcacagatgcttatccaccaacggagtgttagctgacaatcattccaaacaagcccagacaaaaggaataatagcggtaacctgaggaacttcggaagaaatacacagctaaggtctgagaatgtttggccagttcaatagcctcttacgggcaagtccaatgtcaggcggcatttctaccttctcctgttctgcctttgacctcttcacgctctcttgtcctgtccagaacactgtcacttaaactcctctgttttttttttctttttttttgagacagggtcttgttctgtcgcccaggctagagtgcagtggcacaatcacaggttactgcagccttgagctcccaggctcaagtgatcctcccacctcagcctctggagtagctgggattacaggcacatgctaccacacctgactaatttttgtaaagatgaagtctaagtctcaccatgttggccaggatggtctcaaactcctggcctcaagtgatccacctgcctcagcctcccaaggtgctgggattacaggcatgagccactgtgcctggccaaaaacatgtaacactgggggaaattctttcaatcctccattcgccctgacccccccactccaataccaccccactttccaaaagggctcaaaggcttaaggagctgaatgtcggggtactgtttgttagaactgcgaaggaggggcctgtctatccaccgtcctcttggtcctcccctgagatgggagaaaaaggcttgtgttatgctcaggggcaccatggtctccgccagaccggatggaattctggggaaacgttcccacagaaatccagggaagtggagaggagaaagctcctgagggaagaatctaggtggtgctgcgtgtgtgtggtttacatgccagtctgtattttaagaggtttccaagccgattttaattaacctccagttgaaacttgctaaacaagttttgcagcccaggttattgtgttagtatttttccgggtatattgtcctaggtttgaatttcatgatgtttattattctttctaactacaactcagtggggaaaagcccaaggtaccttttaagacctaagtatttcctggtaatgacttgtaggaaagaatgacatttccataacatttggaccaagagaagaagtgagaatttaaagttgacatttgcaagtgataaaagccaaaaccaaaagtattcttttaaagaatatgcctttcttctaatgaaatatacacaagtcttgattcagatgataacttttctagaattacctttgaaaacaaacccttaggtttcttatgctccaacccctaggggacagattcagaacagcttgtttctttcaagtctactcaatcaaggcctgccttctagagacttttcttttttttttttttttttgagatggcatttcgctcttgttgcccaggctggagtgcagtggcgcaatctcagcgcaccgcaacctccgcctcctgggttcaagcgattctcctgcctcagcctcccaagtagctgggattacaggcatgcgccaccacacctggctaattttctatttttagtaaagacggggtttctccatgttggccaggctggtctcgaactcccgacctgaggtgatccacgcccccacccctcggcctcccaaagtgctgggattacaggcatgagccaccgcgcccagtctctaaagactatttttaatgggcaccatatgatctctctggaactgagaagagcggactttggggaaattagaaaagatgtagaaggatgctgctccaagggccttcagaataatcacttgacatcatctctgataagttactctctaggtcatttatataagcctctgccccaagcatataggagagagacatctagtttagggccatcaaactgggaaacatttgttgcttgaggtatacaagaggattccaaggtactgagttttaaggaacttgggttccaaacctcaacttctatatatactctttccagaaatggtctacctgaaaatgctcctgaggttaagaggtcacacttgggctgggcgcagtggcttatacctgtaatcccagcacttggggaggccaaggcgggaggatcccttgaacccaggagtttgagaccagcctgggcaatagagtgagagcttgtctctaaaaaagaaaaaaaattaaaataataataataggaggtcacacttggctcctcttgcctctctcctctttcataaatgcccttcctggcaagatggggtggttcacagctgcactctttttatttatttatttttgagacagagtcccgctctgttgcccagcctggagtgcagtggtgcaatctcgactcactacaaccttcacttcccaggttcaagtgattctcctacctcagcctcctgagtagctgggattacaggtgcttgccaccaccacctgctgatttttgtatttttggtagagatgaggtttcaccatgttggccaggctggtctcgaactcctgacctcaggtgatccacctgccttggcctcccaaactgctgggattataggggtgagccaccgtgcctggcctcggctgtactcttaacactttgggaggaggaggtgggtggattgcttgagcccaggagtttgagaccagcctgggcaacacagtgaaacccctgtccctaaaataaataaatgaatgcccttctcccaccttactaaagaaaggtgtacccctaacctaccctgaatcttagcagagggtgctacccccaaggtgtaaaaacctctgggcaccaaaccaaagaataattcaggaatgtacagctctcaagggaagagttcccagagagttgagaccccttctcagattacttaggtaggagcatgtactggggttttatttcaagtttcacaaagaaagaagctcctcagcaagtcagtttgaagactgctttcttggtagagataaaagtgatacaatgaactatgggttacagagtctcagcagccaggcagctggggggaaaccataactttccagaaaaagattactcaaacattacatcaggattgctgattacgtcccggaacagactgtaaactacctcagccctaaaagttctcttccagattaagtttgggacaatttgctttctcaagacctgaaaaaagagagctttggttaaaaaaaaaaaaaagaagaaagaaaaagaaaagaaaaaaaaatggcagctgtttaatccagatgacaaattgcttttttttttttttttgagacagggtctcactctgtcactcaggctggagtgcagtggcgagatcatggctcactgcagcctcaaccttccaggctcaagtgatcctccactttagtctcccgagtagctggcactacaggtgcacgccgccatgcctggctaatatttttattctaattttttttttttttgtagagacggggtttcgccatcttgctcatggctggtcttgaacccctggcctcaagctatctgcccacctaggctcccaaagtgctaagattacaggcatgacccaccatgtctggtctgcacaatcgtttacaagttagtctgatttggctgattggtttgatagtaaggaatggctttgtcattaagttatagaacaggcactttccattaaccgaacaagctaaatgagctgtgccaagattctgaagcaataaaaatagatttaaattaccagggcgtggtgggggggggggcacctgtaatcccagctactcaggaagctgaggcagcagaatcgcttgaacccaggaggcagaggttgcagtgagccgagatcatgccactgcactccagcctgggcgacagagcaagactgtctcaaaaaaagaaaaaaatagatgtaagccatgtgcataatgtatagtacaccagaaatcacattctttgcaccttttttttttttttttgagacggagtttcactctgtcacccaggctggagtgcagtggtgtgatctcggctcactgcaacctccgcctcctgggttcaagcgattctcccgcctcagcctcccaaatagctgggattacaggtgcctgccaccacacccagctaattttttgtatttttagtagagacgggggtttcaccatgttggccaggctggtctcgaactccagacctcaggtgatcctcccgcctccgcctcccaaagcgctgggattacaggtgtgaaccaccgtgcccgacccctcagctctcagctcaatgtcgcttcctgcaatgtgtccattctacacagggaaatggcggaaggcagcaggtaaaaaaaatcacagcctttcctcatactgcttggcctttttttgttttttaaattctgaagaaagccatctccaagcacttccacctacatttcattggctgcaatgtgtcacctggcaacccttagctgtaagggagtctgggaattctagtattttgctttccagtttctctagtagaaaagtgtgtttctctagtaaaaagtgtttctcatgtgtgtaaagtgagcaaagtgataaagcatatattctaaaaagtaatttggggctgggtgcagcggctcttccctgtaatcctagcactttgggaggtcaaggtgagagggctgcttgaggccaggaatttgagactagtctgggcaacatagtaagactctgtctctacaaaaaattaagaaaatagctgggcatggtggcacatgcctgtagtcctagctacttgggaggctgaggcaggaagattccttgcacccaggagtttgaggctactattgttgccccactgcactccaacctgggtgacagagcaagaccctgtctttaaaaaaactaaataaataaatgaaaataaaaataaaaagtaggccaggtgcagcagcgcatgcctgtaatcccagcactttgggtggccaaggtgggaggatcgcttgagcccaggagttcgagaccagctttggcaacatggcaagaccccgtctcaatttaaaattttaaaaaccaataaaactaaaaagtaatttggaagactgtgaggtaaaccaaataatcaactaacaaagtagttacttaaaaaaacaaaacaagctgggcgtggtggctcatgcctctaatcccagcactttgggaggctgaggcaggcggatcacgaggtcaagagttcgagaccagcctggccaatatggtgaagcctcgtctctactaaaaatacaaaaattagctgggcatggtggcgcacacgtgtagtcccagctactcgggaggctgaggcagaagaatcgcttgaacccgagaggtggaggttgcagtgagccgagatcgtgccactgtgctccagcctgggcgacagagcgagacaccatctcaaaaataaaaataaaaataaataaaattaaaaaacaaaacaaggctaggctcagtggctcacgccagtaatcccagcactttgggtggtcaaagcaggaggattgcttgaggccaggagttcaagaccagcctgcacaacacagtgggaccctgtctctacaaaaataaataaataaataaatataaatataaatataaataaaaacaagccctccaaaaacctttgacagtgtgtaaagctatgcaattttctaatcgtgttaaagtaaaagcagttcacaaacaattcagactatacagaaataaaaagtagtatatatggcctaacattactttgttcttaaaattttccagtgacttttcttcccacttccaactccaactgccctattccagaatgtcaaatgattgtgacttgcaggttttctaatcagcacgtaagtcggaaattctaaaaatacattttaaattgtggatcacaccattacatgactgtctatagagccatttaattttgaaggcaagttaattttaaaaatagttacacacaaatgttcagttgattacgcttaagacagttttattctggtgattcagcatgatttttttcaacaaattaggtactttgtctgctttgtggaacattggcagtttcatttcctgttaaggaagctatcatcagaactcagataaacctttgcctttactatttgagtactgaaaataaacaaagaatataaaactcacatataggctgggtgcggtggctcacacgtgtaatcccagcactttgggaggccaaggcaggcggatcacttgaggccaggagtttgagaccagtccggccaacatggtaaaaccccatctctactaaaaatataaaaattagccaggcatggtggcacatacttgtaatcccacttacttgggaggctgaggcaggggaatcacttgagcccaggaggcagaagtagcagtgagccaaaatcatgccactgcactccagcctgggtgacagagcgagagtccgtctcaaaaaataaaataaaataaaaaataaaacacacgtatatacttggggacagaaacatcaaatatgttttctggatgatttaaaggtttagaaggggattatttattctaactgaaaaaaaaatcttttaatatgaattatttatatggaagacttctttttgaagctgttgtggctgatgctgttggattcatgtctaacttctttcattttataaaacagaatcatatcatcatcacaatctgtacactcccacctatactcttagggggcagtctggggtggttcctagggtaacaggcccaattatcccagtatacattgcatacagtaccctaacaacttttaggaaaggttttcattattagtgctttgttttagaaaaagtccaaaacaagccctaatgaagagtccaaaggataaggaagatgaagagaaagagaaagcactgaaaagtagaatcacatgatttgcaagtaggacaaggaaagcgagcaggaaaaaaaacagagttgtcagaacctgtggggaaaatgtgctgaacagcaagggctgagaaatgagcaacatattaaactttttttttttttttttttttttgagatggagtctcactgctgttgcccaggctggagtgcagtgccgacatctcagcttactgcaacctccatctcttgggttcaagtgaagctcctgcctcagccttctgagtagctgagattacaggcacccgccaccatgcccggctaattttttgtatttttagtagagacggtttcaccatgttggccaggaactcctgacgtcaggtgatccacccgcctcggcctcccaaagtgcccccatttcctttcattcgtttggagaactcctctactgcttgcatggttacctggtacaatgatcagtcatgatgccctgcccctctccaagaccatcccaaagagttggctcagggctgggcaaactgggccaagccaggatttcatggctaacactatttcgcaatagttcgcaagctggaggctgtagcctgggactgttggctgtcatcttccttgccttgagggtgcgcctgctacaaaatgcagctgaagggtggcagaatactctatgccaaaatatgccaccatgacgtaaggattacttcaagctaaaggcacttgaaaaacagcagatacaagaagggcattctaatctcccctttgcttcctgcaaacaggagagagaaactcccatgtgaacatgccctccctgtaccaggaaaaaagtaacattcttccccggggagtcacagctctgagaatcctgtacaaacatactttgtgaaactaattcttaccttcctttaacaaactccccacataatttagttacttttccacaactgcctctctttgttcaacctaatacaaaagcctgttggttttgtcacttctttgggtcttcatttccttcccagggctcctgagtcacataaaacttacattaaattagtacgcttttctcctgttaatatactttatgtcaatttaattctcaggctcagccaggacactaagagaagagagttttgactctcctgcacattcaagacctgtgggaatctgagccaagcattgacataacagcgcagcagcagtttatgatctctctcttcctttcctttcctttttcctttcccctttccttttctttctttctctctttttctttctttctttccttctttctctttctctctctctctccttccttccttccttctttccttccttcctctttcctttctccctccctccctcctttctttttttttttgatacagagtttcgctcttgttgcccaggatggagtgcagttggcaatcttggctcactgcaatctttgcctcctgggttcaagcgattctcctgcctcagcctcctgagtagctgggattacaggcacccgccaccatgcccagccaattttcgtatttttagtagagacagggtctcaccatgttggccaggctggtcttgaactcctgacctcgtgtgattcacctgccttggcctcccaaagtgctgggattacaggcgtgagctactgtgctcggccctttctttctttttttttgacagggtctcgctctgttgcccaggctggagggcagtggtgtgatatcggcttactgcaacctcgacctcttgggctcaaatgatcctcccacctcagcctcccaagtagctgcaactgcaggtgcgcaccactatgcccggctaattttttttattttttgtagagacagggtctccctgtgttgcccaggctggtcttgaactcctgacttcaagtgatctgcccacctaggtcccccaaagtgctgggactataggtgtgagccaccaagcctgaccgatttcttttttcgggaattcctattccgttctcagtccttgaactcccagcgcaagactccaccccaggtcacagggctcagtcccactcagaactgtacctcttacttatagactgacccgtattgcttaatagatcacatggcgtagctttcctccctgcctgagtcctaaacggcttgccagcatgtcatgttatgcttttttctgcctcctacctttcacagcacccgcaggcctggcatgtagtagagtaccagataagacttggtaaatttgatccttttttttttgtcttttttctgagacagattcttgctctgtcgcccaggctggagtgcagtggtgcaatctcagctcaatgcaacctccacctcccgggttcaagcaattcttctgcctcagcctcctgagtagctaggattacaggtgtgcgccaccacgcctggctaatttttgtatttttagtagagacgggggtttcaccgttttggccaggctggtcttgaactcctgacttcgtgatgcacctgcctcggcctcccaaagtgctggggattacaggcttgagccaccgtgcccagcctaaatttgatttttttttttttgagacggagtctccctctgtcgcccaggctggagtgcagtgtcacgatctcggctcactgcaagctccgcctcccgggttcacgccattttcctgcctcagcctcccgagtagctgggaatacaggcgcccgccaccacaccctgctaattttttgtatttttagtagagacggggtttcaccgtgttagccagatggtctcgatctgcctaccttggcttcccaaagtgctgggattacaggcgtgagccaccacgcctggccaatttgattcttttcttatgacagaaactataatacagcgagaatgtttttctttttttctttttcttttttttttttctttttttgttttttgagatggagtcttgctctgtcaccagtctggagtgcagtggcacgatctcggctcactgcaagttccgcctccaggggtcaagtgattctcctgcctcagccccccgagtagctgggattacaagcacctgccaccacgtttttagtagagacggggtttcacaatgttggccaggatggtctccatctcctgacctcgtgatccacccacctcgggctcccaaagtgctgggattacaggcatgagccaccgcgcctggctgagaatgtttttctaatacgtgattaaataggcggctatcgaggaacaacatttattgcacataacttacattatcttgtttaatctgtacaagcaatttatgaggtagatgtgtaagtttatgaccttggaatgttgaaccggttgtaaacagatgaaaacaagtacctctgactccaaattctgtgtaagaaaacgactgcccatggccaggcacagtggctcaagcctgtaatcccagcactttgggaggccgaggtgggcggatcacctgagctcaggagttcgagaccagcctggccaacatggcgaaaccccgtctctactgaaaatacaaacattagtcaagcgtggtggcagatgcctgtaatcccagctacttgggaggctgaggcagaagaattgcttgaacccgggagggggagcttgcaatgagccgagatcgcgccactgcactccagcctggacggcagagcaagaccgtctcctcccaaaaaaaagaaaaagaaaagaaaacgactgcccataaagactcctcttcaccccctcccaccagctaataagcaaacgtgtaccaccatatcattatatccagaatctaaggggtaaagggcattcaaggacaaggccttacatgctaaacaaactgtgacaaattctccacttgagtcttgtcaaatagatttccctagcagcaagatatgtgactcagtgtaggaaaaactaaccactggtgcagaacacacatttgcttagaaagccttaggccaaccttaattaccctgcctaagaaagagaggcctccacagggggcggggaggagggaaaacaagctagttgttggactggaagcttccagaaccacagctgtagcccttaacaggatagctgacctgcgcctttcatttgctttgatttcatgtatgagtttaattccaaagttgcaaataacaggaaatgaaccacagtgttagccagttaacatcaaaggtagaaggagaccggcaggcggactgttaaaagaattaaaagagtaaacattccggtgagtcattagctttcaatactcactagaaccactagaagcaaaactgcgtgggaacctacaagtggacactccaagtaagagcctacctggaggccgggcacggtggctcactgctgtaatcccagcaccttgagaagccgaggcaggcggatcacgaggtcaggagttcaagaccagcctggccaggtgtggtggctcgtgcctgtagtcccagctactcaggaggctgaggcaggaggatcgcttgcacctgggtggcagaggttgcagtgagccaagatcgcaccacttgcactccagcctgagtgacagagcgagactccatctcaaaaaaaaaaaaaaaaaaaaagcctacctggagttctttgaaacatgcaaagttctggccgggcgcagtggcttacgcctgtcatcctgtcatcccagcactttgggaggtcgagtcactgcttgaggccaggagttcgagaccagcctggccaaaatggtgaaacgttgtctctactaaaaatacaaaaattagctgggcctggtggtgcatgcttgcaatcccaggtactgggaggctgagacaggagaatcgcttgaacccaggaggcagggggttgcagtgagccgagatcacaccactgcactccagcctgggtgacagagtgaggctgtgtctcaagaaacaaaacaaaaaaagagattggaccgtgtgcgtgtgtgtttgtgtgtgtgtgtgtgtgtgttttgagacagagtctcgctctgtcaccaggctggactgcagtggcacgatctcagctcactgcaacctctgcctcccaggttcaagcaaatctcctgcctcagcctcctgagtagctgggactacaggcgcccgccaccatgcccagctaatttttgtatttttagtagagactgggtttcaccatgttggccaggatggtctcgatctcctgacctcatgatctgcccaccttggcctcccaaagtgctgggattacaggtgtgagccaccgcgcccggccatgtgtgtgtattttaacaaacaatcagagtactttggtgtaaaggtatagaacagcagagctcgatcaagaagtttccttcttttttttttttttttttttttgagttggagtctcgctctgtcgcccaggctggagtgcaatggcgcgatctcggctcactgcaacctccacctcccgggttcaagcaattctcctgcctcagcctcccgagtagctgggattacaggcgcccgccaccacgcttagctaatttttgtatttttagtagagacggggttttgccatattggccaggctggtctcttggccaggctggtctcgaactcttgaccttgttatccgcccgcctcggcctcccaaagtgctgtgattacaggcatgagccactgtgcccagctagaagtttccttcttaacagcaccatctgtctgaacaaaagtatacataatattagccataaaaatatgtaatggtgggcatgcagtagctttgttttttgtctagttttatttcacctaataattaaagagagctccaaaggagaaaaaagtagatttctaactcctctttatctctgagaattcattctagtagaggaaatgaagtttgatgagacgagaccaaaaacagtacaaagaagtgaaaaatcatagattgaaaatgaagctaaattttgaagagtctgatctcaaaatgaaaggcccactactggaaggttgctataatttcattttgtaatttcaatttgatataaattctgctccacccatttttttctcattgtgtgacaaaatattggtgtttccttgacatacacttctttttcttttttcttttttttagacagagtctcactctgttgcccaggctggagtgcagttgcatgatctttgctcactgaaacctcagcctcctgggttcaagcgattctcctgactcagcctcccaagtagctgggactacaggcacgcaccaccacgcccggctaatttttgcatttttagtagagacagggtttcaccatgttggtcaggctggtctcaaactcctgacctcaggtgatccgcatgcctcggcctcccaaagtgctgggattacaggcatgacccacggtgcctggcctgacgtacacttcttaatcaacaaacagattaaaacttaggtatctgagttaaaaaccaaaagatgaaaacggtatagtggttcctcaaaaaattaaaaatagaactacctgctgggtgtggtggctcacacctgtaattccaacaccttggaaggccaaggtgggaggattgcttgaggtcagggattcaagaccagcctaggcaacatagtgggactccatcttcataaaaaaaaaattaaacaattagccaggtgtggtggtgcacaactgtggtcgcagctactcaggaggctaaggtgggaggatcacttgagcccaggagttcaatgctacagtgatccaagattgcatcactgaactccaacctgggcaacagagtgagaccctgtgtcaaaataataaaatagaattaccatctgatccagcaatcccacttctgggtatatagccaaaagaactgaaagcaggatctcgaagagatatttgcacacctatggttttcatggcagcattattcacaacagccaagaggtagaaccaacccaaatgtccattgatggatgaatggataaacaaaatgtggtattgtccatacaatggaatattattctgccttaaaaaggaaatcctagctaggcatggtggcggctcacacctgtaatcccaacactttgggaggccaaggtaggaggattgctttagcccaggagttcgagactagcctgagcaacatggagagacccccatgtctacaaaaagtcaaaaaataaaaaaggaaatcctgtcacatgctaaatcatggatgaaccttgaggacattatgctaagtgaaataagttcatcacaaaaacacaaatgctgtctgattccacttatatgaggtgtctagagtagacaaatttgtagagacagagtttagaatagtggtcgccaggagttggagggagggagaaatggggagttatttaataggtacggagtttcagttttgcgagatgaaaaagttctggagatctgtctcacaatttgcatatagttaaccctactgaaatatataccttaaaatggttaagatggtacattttatgtgttttttaccacacacaaaaaaaatcttggtttcaaacatcagaaacagaatttaggtaactcgagggaagaaaatttgggaagcctatctcaccactcacagaatctctgggaagactaaagatccaaactcagcccgtagaacaagaaaggctgagagtcaaaaactgggatgttcccttgaagtctgagagatttgcatgttcccttgactgggaagcagccagtaataaatctcaggtttgcaaatatggtgagaaaaaaattagaaaagaggaagcctgagttgaaagaagtcaaagggtttaagcagcaggcgcacccgctctaaattagggacgggaagagacgtgcaatcgcagattatgaaacaatgaaaggcagaggacgcaatcgtactcctaaaagatcttccattgtgacataagtattttgatctaaggctgagtctgttctcattgtattaaaaaaaaaaagtccctctttggcgggggctaaaaacaaaatctgattcatattgaatttcttcccaaaggttacacaaagggaagtaataatgccgactgtgagaattgaagtgaaaatcagatctcagcccaaccagaacaaccaatgggaacaatagacaataactgtgactctaatgaaattcatttctcagctgaaggcactgagccgatgtttctcttgctctattcttagtactaaatcgaactttttccccttcagggaaacagctcccttcagatttaaacaatagatattcaccctgcattccatatttgatgggttctcagtgttggctaaaatgtcataacctcctctcttcccccaacaagatatgacccacatttcctctcttcgaggggtgtcacagctgttttaaggacatgcgtgtgtagagttggagtaagcggcctcaagagcagtactgatagcatgggcaggcccaaatttgggaaatgggtaaaacctgtaaaaatagtcttgcaggttttaacgcaattgcaggctaaaatgaaaatttatgacaacggaaggcagagatgacacctatacctatattcctttgtatagtactttattttccttttttttttggagacggagtctctatagcgcaggctggagtgcagtggcacaatctctgctcactacaacctctgcctcctgggttcaagccattctcctgcctcagcctctcgagtagctgggattataggcacacaccaccatgcccagctaattttttttttttttgcatttttagtagagatggggtttcaccatgttggccagactggtcttgaactcctgacctcaagtgatttgcccacctcagcctcccaaagtgctgggattacaggcgtgagccactgcgcccggccagtaatttctatcttatggaaaataactgattaaacaggacctatggttgcaagtgagagaaagcaactcaaactaagcaaaaataaataaataaataaataaagccaggcacagtggctcaagcctgcaatcccagtgctttgggaggccaaggcagacagatcacgaggtcaggagtttgagaccagcctgaccaacatggtgaaaccccatctctactaaaaatacaaaaattagctgggcgtggtggtgcatgcctgtaatcccagctactcaggaggctgaggcaggagaatcacttgaacctaggaggcggaggttgcagtgagccaacatcgcaccacggcactccagcctgggcaacaagaacgaaactctgtctcagaaaaaaaaaaaggaatgtgtttggtccaaacaactggaaagtcgtcggatctgactttagtcatgactagatccaagagtaaatagtcaccaggctcttgtcattccatcccttgattatggaggaggaatacagtcaaactcatccaaagcacatagaatatatttctcagtggaaagagggcttatcagatgaaggggaaatgagtcctgggaagacaaaaacagcaaatatccaccagactgtgagattttgaagattaaaaaccatgtcaggctgggcaaggtggctcatgcctataatcctagcactttgggaggccgaggtgggcggatcacctgaagttgggagtttgagaccagcctggccaacatggagaaacttgtctctactaaaaatacaaaattagctgggtgtggtggcacatgcttgtaatcccagctactctgaaggctgagacaggagaatcgcttgaacccgggaggtggagtttaccgtgagccaagatcacaccattgcactccagcctgggcaacaatagcgaaactgtctcaaaaaaaaaaaaaaaaaagctatgtcttttttttttttttttttttttgagatggcgtcttgctctgttgcccaggctggagtgcaatggtgcgatctcagctcactacaaccttctcagctaatttttgcatttttttgtagagacggggtttcaccatgttggccaggctggtcttgaactcctgacctctagtgatctgcccaccttggcctcccaaagtgctgggattacaagcatgagccaccgcactcggctaaaaaccatgtcttaacgtttcatctccagttctatgcctgcaatttactgacattcagtacgtgtttgctgaatgaataggacaagtatatctggtatctttatactgaacacatcaaaacaagctcattccctaaatgcaaagggaatgagggaatgaactggatttcctagtgaccatgcccacactggcttttaggctgttgtggtatagactttagctggctaccatatctctactctctaattctctctcaaactaaaagaatcccaatttttcacttagcatattgcctcccagctgaaagactacatttttcagactccattgcagccaggttaagttacagtcaatgagtaagctgaagtattgggtggaactttggggaagtcttggaagggaggtggcacatactccttcctctcttcttctgttctgcttcttggaactatgatgtgatggctggagctccagcaatcattttagaccttaaagatgaagactataccccaggaatggcaatgtgaaaagctgaaacaaacctgggtcccttatgtccctggagctgtcataccagtcctggactgcttacgtataaacttcttttatttgagaaataaattctgtatttttgccatgaattttaaggtctctattactcacatctgaacccattccaaacggatacagctgtggtctccaaatatacagaactaagggagaggtctcagaccccacagtccctctccccttcccctcctcaaggcatgaaacccagtctatgaagagtactagtcctctacctcccaaaggcatcccagcttggactgctgtcatgatctcttcttgtgtaactgaaggcatcctcccagttcctgactcctcttccctgcttctaggagccagtgcagtgccatggtgcttcctaaagactccccttgccggatgggcgtggtggctcacgcccgtaatcccagcactttgggaggccgaggcgggcggatcacctgagctcaggggttcgagactagactggccaacatggtgaaacctcgtctctactaaaaatacaaaaattagccgggcatagtggcacacacttgtaatcccagctatttgggaggctgaggcaggacaatcgctcgaaccctggaggcagaggttgcagtgagccaagatcacgccactgcactccagcctgggcaacagtgcgagtctgtctcaaaacaacaacaaaaaaaacaaaactaaactaaaaaaaaaaacaaaaaacaagcacctattacgctcagattctgtgagtcagcaattccatcacggcacagcagcagggacaggttctcactgcttataacatctcagctggaagatttgaaggctgggggctgtcatcactagaaggctcacatcgtcacagagctgctgagtgatgctgcctgtcagtgggtacctgcaccattcctctccatggggcctgcatttcctcacagaatggtggttgggttctgagggtgacaatgacgagagacaaccgggtggaaggttatgacctaacctcagaagtcatgcagtatcactttggctgcatccaggtcattgtgggggaggtcactaaggtcagcccatattctttttttttgtttcttgagacagagtttcactctgtcgcccagactggagtgcagtggcgtgatcttggctcactgcaacctccacctcccgagttcaagcgattctcatgcttcagcctcccgagtagctgggattacaggcgcatgccaccacatctggctaatttttgtatttttagtagaaacgggtttttaccatgttggccaggctggtcttgaactcctgacctcaggtgatccacccgtctcagttttccagagtactaggattacaggcgtgagccactgcgcccggccaagtcagcccatattcaaagggaggaaaattagactctaccttttggtgggaggaatggcaaggttttacaagaatatgtggaactagaaatattgctgtggccagcaggtttggtggtatatgcctcaggctgaaaccacctgggcgtgtactgggactccctctgggataatggctttgtccatgggtacaaatcacctataggagtatgaaagactggccgccactccagtccttgcgattactaattttcagtagatgatcaggtggtaatgaccacatggctgtctttcatttaggactgacccattcagacctagtaaacccctcggggggaagagagggagccagagagagagagagagaatatgaaaccggactgcctactaatttgggtatgtgtgtttttgaccaattaatttcattacagcaaagtgacactggtaccttaagctggtcaagaggtcatacctactacaattttaatatactaacttgtgtgtctgcctgtctcacaacccagattagaaactcttttgaggacaggacccatcttatctggcttccccaaaggatttcacgacatggctccttggagcaagggatttaaattgctctggcatgtggccttagatacggtacttaattgtgccagactttagtgtcttcatctcagattaacaggattcaatgaaattattatgtcctgaatctagaaggatgctcaatacatgttagttcctttctttcccgtacacggattctccccaccccacccttccccatttaccttatttatttcccatgagcccttcctcttcccaactcctcaggatcgtaatgctccaggacttccctcagccctgcaggtctgcttcccacagggagtttcactgcttcaactgcaggtaggagctgggaaggcaggaaggagccagagtcctcctgactgaaaggaacggggagctgggctgccctggggttaggggtgaggtgagttgctacagcaagttaaatccctttcatttattgatgaaacaaatattgattgcctctcaccaggtcccatgcactgtgcaaaaagctggggacacagcagtgaggaggaaccaggtctcttaatccttgtagacttttggaatttatgttgctcattagcgtttttgtttgtttgtttgtttttttgagacggggtctcgctctgccaccgaggctggagtgcaatggcatgatcttggctcactacaacctctgcctcccaggttcaagcgattctcccgccttagcctcctgagtagctgggattacagatgtgcgccaccacacccagctactttttgtatttttagtagagacggggtttcaccttgttggccaggctggtcttgaactcctgacctcatgtgatccgcccacctcggcctcccaaaatgctaggattacaggagtgagccaccgtgcccggccctgctcattagtgtattgtatgtgtgggcaggtagggggaagatggggtagataaaagactaacaaataaaatataatagagtgatagtgcaacaaggaaaacaaaactaccttctcctggttggtcaggacacacccaaacaaaggtcaatttaggtcagacctggatgacaaggagctagcctcacaaagttgtgggggcagtcctgtgcactgcgagatgctcagcagcatctctggcctctacccacaagatgccagtagcatgcccctcctaaggtgacacaacccaaaatgcctaggggacatgatggcctgactgagaaccactgggttaaggcaagggcattcccagcaggagaaaccagcaagtgcaaggaaggaagaaggccccagcctgcctggcctcaccagctcccgctgccctgcctgctaggtgaatctgtcaactgtggcaaagtagcaactgatgctcagagtggagaggggtaataaaccaggaagtgagactggccaactgggggtgaatacttcctggttcaacacttcagctgtgggctgctcatcttccccactcacagtctgagactgaggccagacagtctctgaatacatcagggcacacagtcaagtaggtaccatgggtgagtctgggctatgtattgcttccctgaagaggactccttgctgcccagggaactcagagaagggccaggcagtcacttttctatcatttgagaccagattttttctttttttttgagacacaatcttgttctgttgcccaggctgcagtgcagtggcatgatctctgctcactgcaaccatctgcctcccaggttcaagcgattctcctgcctcagcctcccgagtagctggaactacaggcgtgcaccagcatgcctggctaatctttttataattttagtagagatggggcttcaccatgttggccaggctggtctccaactcctgacctcagatgatccacctgccttgacctcccaaagtgctgggattacaggcgtgagccactgcacctggccgagaccagatttttagttgcttttagcagctgccttagttactggaaaaagtaaatccaaacaactctaactcaaatttatatcctgtcaattcattatctccatcattggtttcctagaaataggtaatgaaattaaataagccatgaagagataaacaattgagccagtaccacctgaactctctaagtatattttgattataccttgaggatgttctcatttagagactatatgcaacactatatggtacagaaaagggtgttggggcagagttcagataacaggggtgctgctcgggcaacgcaggacagtctttttttcattattttattattgtaaaaaacaaaatttaccatcttagctttttttttttttgagatggagttttgccaccacatcccgcccataatttgtcttgtgactggcttaatttcacttagcaacaagtcctcctttttcatccatattgtagcatgtgacaagatttccttcctttttaagaccaaataacattccactgtatacacatatcacgtgtttatccatttatctgtcaatggacatttgggttgcttccacctcattgctaatgtgaacagtactgctatgaacaggggtgtgcaaatacgcagttttaaaaaacatctttggctgggcgcagtgactcatgcctgtaatcccaacactttgggaggccgaggcaggcagatcatgaggtcgagagattgagaccatcccggccaacgtggtgaaaacccgtctctactaaaaatacaaaaattagctgggcatggtggcgcacacctgtagtcccagctactcgggaggctgaggcaggagaatcacttgcacccaggaggcggaggttgcagtgagctgagatcgcaccactgcactccagcctggcgacagagcaagactccgtctcaaaaaacaacaaaaaaccatctttattgagatataattcacatatcataattcacccatttaaagtgtacaattcaataattttcaacagaattgtgcaacctcactccaaaaagaaacaccattagaagtcacttcccacccctccatgccagtttatgtgtcaacttgactacagtccccaggtgatcaaatactaatctaggagctttggtgaaggttatcctgtagatgtgataaaaatccataatgaggctgggcgttgtggctcacacctgtattcccagcactttgggaggccgaggcaggtggatcacttgaggtcaggagttcaagaccagcctggccaacatggtgaaaccccgtgtctcctaaaatacaaaaattagccgggcgtcgtggcacatgcctgtaatcccagctactcgggaggctgaggcaggagaatcgcttgaacctgggaggcggagggtgcagtgagccgagattgggccactgcaccccagcctgggtggcagagggagactccatctcaaaaaaataatttaaaaaatacaaaaattagccgggtgtggtggcacgcacctgtagttccagctataggtgaggttacgtctcaaaaaaaaaaaaaaaagtccataatcagttgacttctatataagtgggcctgattcaatcaggtgaaagaccttacgagctgaactgaggtttgcctgaagaagaaattccatctatggaccacagcttccactcatgcctgaaaactccagctgccctttctgcttaccagccctatggatttcagactagcctggccagcccccacagtcggctaagccaactccttgcaataaacctctcaaaatacatctcctacgtgttctgtttctctagttgaaccctgattgatatgctccgccctcccccaatcattggagtcttaagcaactatgaatctactttctgtttctttgtacttgtctattccagacattccagataaatggaatcatacactatgtgctcttttgtgatgggcttctttcactttagcataatgttttcaagtgtcattgacgtggcatggatcagtacttttttctgagacagggttttgctctgtcacccaagctggagtgcagtggtgcaatcatagctcactgtaaccttgaactcctgggttcaagtgctcctactgtttcagcctcctgactggctaggactacaggcatgtgccaccacacccagctaattgtaattttgtagaggtgaggtctcactatgttgcccaggctagttttgaactcctggcctcaagtgatcctcctgtcttaactcccaaagtgttgggtacaggcgtgagacaccacacttgaccagtacttcgttcttttttacggctgaataatattccattgtatggaaatacattttgtttatacatttatcagttgatggacatttgattgtttctgttgtgactatgataaataatgctgctatggctatctatgtacaagcttttgtgtggacatgtgttttcatttttcttgggtatatactgcagtagagaagaaatgctgggtcacatgtttagcattttgtggaactgccaaactgttttctccacatccttgtcaacacctgttcttatcttttttatcctagtgggtatgaaatgacaccttgtggttttcatgcgcatttttctgatgactaatgatgctgaacagcttttcatgggtttattggccatttgtatatcttctttttaaaaatgtctgtcaggctgggcacggtggctcatgtctgtaatcccagcactttgggaggccgaggtgggcagactgcctgagctcaggagttcgcaaccagcctgggcaacacggtgaaaccccacctctgctgaaatacaaaaaattagccaggcatggcggtgtgcgctagtagtcccagctactcaagaggctgaggcagaactgcttaaacccaggaggcagaggttgcagtgagctgagatcgtgctactgcactccagcctgggtgacagagcaagactccatctcaaaaaaaaaaaaaaagagtctgttcaaatcctttgttttattttttgagagggagtctcactctgtcgcccaggctggagtacagtggcgtaatctcgactcactgcaacctccgcctcctgggttcaagtgattctcctgcctcagcctcccgagtagctgagagtacaggcgtatgccaccacacccggctaattttttttttgagacagtgtttcgctctgttgcccaggctggagtgcagtggcacgatctcagctcactgcaaccttcacctcccagggattctactgcctcagtctccccaataactgggattacaggcgtgtgccaccacgtttggctaatttttgcattttttgtagaacagggtttcaccatgttggtcaggctggtcttgaactcctgacctcaaatgatccacccgccttggcctcccaaagtgctgggattacaggcgtgaaccaccacgcctggccaatttttgtatttttagtagagacggggtttcaccatgttggccaggctggtcttgaactcctgacctcagatgatccacccgccttggcctcccaaagtgctgggattacaggcttgtgccaccgcgcctggccctctgctcagttttaattgggttgttttcttattgttgagttgtaaaagttctttaaatattctgtatatgcgagcctcttatcagatctatgtacaaatattttcctgtactccatgggtttttttctttattacttttttaatagaaatgaggtcttgctatgtttcccaggtgggtctcgaactcctgggctcaagcaatcctcccacctcggcctcccaaagtgctgggattacaggtgtgagccactgcattcagcttgtttttttaaagaaagggttttattgtcacccaggctcatggcccactgcagcctcaacctcctgggctcaagcaatcctccatcagcctcctgagtagctgagactacaggtgtgtgctaccacgcctggctaattttgatatttttttggtagagacagggtcttgctaagctgcccagggtggtttcaaactcctgggctcaagtgatccacctgccttggcctccctaagtgctgggattacaggcatgagctaccacacccaactgcctttttattttcttgatggtataatttatagcacaaaagtttctacattctgaggtagtccaatttatctgttttgtcacccgtgcttttggtgttgtatctaaaaaaccactgcctaacccaagatcacgatttactccttttccaagatttattcctatgctgtcttctgaaagtctaacagatttagttacgacatttaggtgtatgattccacacagacttctaaaagtctcacctatttggtagtgctttcccagggaaatatttatggcaccactaagaaacaaacaattaaactattgtgtttaaaacaaaatgtgcaatgtgtgctctttagcattctgatctaggctgagaacaatatttgaaatgagccagtgctctctctgtaggacaaataaatgctttcataaagacgtcacttttgaatggagtgcagtttatgacctatttacttatgaaccagcccaaaccgcttgcctccatagcgtgagggaaggaagaaagactctactgtgagaatcaggaaaaaaacccaatcactaatttggtctaaacaagggagcttagagttttctgtggctttcaaaaactactttctctttgcttgaagaagatgaataaaaacagtttttttaatgtcttgtgacctggaaatatttaatgtaaatataatggtccttttatttatgttcttctaaagctgatggcaagatggcatgacataaaacaaacaccatcttaacatgctgttttcggtggtgggtcctcaagatttgcttaaaatgactcaaaggactcaacatacatgttctcatgccttaggtttatcctaacaaaggattcatgacaggaccagcaaaggaaaaagacacagcagagtctggagaaatccacacacaggcttcccatgctttctccctcccaacccgggagggcacacgttgagcatgctcccttctccagcagcaaaactgaagccacacgtgtgcaatgcttctgcccagagaagcctatcagagattcaccgccaaagcctttttttgttttgttttgagacagaatctcgctctgtcacccaggctgaagtgcagtggcatgatcacggctcactacagcctcaaactcctgggctcaagtgattctcctgccttggcctcctgagtagctgagactgcaggcgcgtgccaccacacctggctaatttttgtgtttttagtagagatggggtttcaccatgttggtcaggctggtctcaaactcctggcctcaagtgatccacctgcctcggaaagtgctgggactacaggcatgagctaccttgcccagccggcaccaaagggttttattggagtctggtcatgtaggcatcttctgcctagcaatgaccaaaattcaccagattcacagaaggaagccaggcatttgccataactcacaacgtttgcacagtctctgtgacctgatacaacagagcttggtgccctagacttaatgagcatagggaactttcgggaagcccagtttccgaaaggccaaccctgcaagcaggtctttttgaagtcagcagactcaggcttgctatggtaactctctcctgtgtagaggtcacgtcattcatgcaagcttgaattttatgtttacttaaggaaacactcaccttaatgtttattaatattctgaatttgtaattatttcagtgagctgaagtttattcctatctatgaattttaaaaagtaagtatattactatagtaaatactgtctaatggcatgtttaagctgctaaggagctaattaaaggacagtggcataacttatgaaaatgacattattaatttttttttgagatggagtttcactcttgttgcccgggctggagtgcaatggcgcaatctcaactcactgcaacctccacctcctgggttcaagcaattctcctgcctcagactcccaagtagctgggattacaagcatgtgccaccacacccggctaattttgtatttttagtagagatggggtttcaccatgttggtcaggctggtctcaaactcctgacctcaggtgacccacctgtctcagcctcccaaaatgctgggattacaggtgtgaaccactgcgcctggccaatgaaaatgatattattaattctacattaaacatatctattaaagcaggacatgcaggatctcgactggcactactcttagccagatgttcaaattcctattcatggccaggcataggggctcacgcctataatcccagcactttgggaggctgagacgggcagatcaactgagtttgggatttcgagaccagcctggccaacttagtgaaaccctgtctctactaaaaatacaaaaaattagctgggtgatggtgcatgcctgtaatcccagctacttgggaggctgaggcaggagaattgcttgaacctgggaggcggaggttgcagtgagctgagattgcaccactgcactccagcctaggcaatagggcaagactccatcccaaaaaaaaaaaaaaaaaaaaaaaaaaaaaattcctgtttacatgtgaaagtaataagacattaactattttccatatacaatagcattaatgagctagagggatacatcaagggctgctcaaaagcccaattctgggctaatacttgctagacttgctagggacagaaggtgttccaagcgaaaaacagtgatcacacaaagagagcatgagctaagtcctaacagtaaaaccatacatctgaagcctgtattccctgttttaccaggcttgtttcctctgattacttttcttccttacctaaaagagttagtgtacacaaaaattttaaactactgcctaggtacactcatattttactttttttttttttttttttttgagacagggtcttgctctgtcacccaggctggaatgcagtggcacaatcttggctcactgaagcctcaacttcccaggctgaagtgatccttccatctcagactcccaagtagctgagactacaggcgtgcaccactacacctagttaatttttttttttttgagatggagtctcactgtgttgcccaggctggagtgcagtggtgcgatctcagctcaccacaacctccgcctcccaggttcaagcgattcttctgcctcagcctcctgagtggcttggatcacaggtgcgtgccaccatgcccggctaatttttgtatttttagtagagacagggtttcaccatgttggccaggctggtctcgaactcctgacttcaagtgattggcccacctcggcctcccaaagtgctgggattacaggcatgagccactgcgcctggacaattgactaattttgaaatttgttttgtagagttgggggtctcactatgttgcccaggctggtctcaaactcctaggctcaagtgatcctcctgtcttggcctcccaaagtattaagattacaggtatgagccacctctcctggcaacattcatattttagacaaacatccttgggtgcttctttgcacaagaccaaaatacaaaatcagtatctaccacagattgtacattatgataatgctgcctgtaactactctgattgtttcatgtacttactttgtctttgaatctgaattgtaaaaggtatttctctacctgcccaccataacaaagtatctacaccaggcattcagtgagtgcttaataaatctaagggggagaagccatagagattgaaggcctttagagagttcctcttttttagatttggaagttagaaacagagacatgtactctgaggttgaggacaaacaaatcaaatacctatgcatatcctatagaggttttgattgaaacagaatcaatgcaattttgaactttcaagaattcacacattcacaatgtatatatcactgcattagatcagcactatgggaacactaagaagaaggacatttgtcctggcctcaggaagattatagcctactaggggagatcaggtatgaacaaacaagggtagaacaggcatgaagccataagaaatctagaatgtgatctaggagttcagagagaaaaggttttcatgtctggaaagtcagttcttcagaaaggtaccagtgatggtgaattcaacagaagtacaagtaagtttaaaagggtatcaaagggtacaggcttttcctacatctcacatcctgcacataaataacaagaacagaacgtgtcccaacgggaaaacagcaatcacacaaagaagactgttagtagtaagttaagcatctttaggtcagcaggaccacaaagagccagtaacacaacatgaggaatggaaaacaataccatgtttgtttggtaagatagagaggaagtatggaaaggagaggaggtacaaacaggagacaagtggggtgtatgaggaaggaaaggctcccaggagcacgatgcttccagttctgaagagcacctgcaaggggaacaacacactaagtggtctctgcttttcttcataaaatgacacaacttccaatccagggaaacaggtccaccaacaggtcacagcttccctcttgagcaatggtgtaactgagggttgtattcctgacaaaagattcagaaaatgaatcagctttttaaaattttgttgagacagggtctcactgtcacccaggctggagtgcagtggtgcaatcacagctcactacagccttgacctctggggctcaagtgatcctcccacttctgccttctgagaagctgggactacaggaacacatcagcacaactggctaatttttgtatttgttgtagagacagagtttcaccatgttggccaggaggtgtcttgaactcctgggctcaagtgatccactcatctcagcttcccaaagtgctagaattacaggcataagccaccacacctgttattttttttttattccccttggagacggggtctcactgtcgcccaggctggagtgcagtggcacaatcatggctcactgcagactcgatctcctgagttcaagtgaccctgctgagtagctggtactataggcacatgtcactaagcccagctaatttttaattttttatagagatgggggtctctctctgttgcccaggctggtctcaaactgctgggctcaagcgatcttcccatcttggcctcccaaagtgctaggattacaggcatgagccactgcacctggctgaatcagagctttgacaaagtgccacagacacaaagacacccataaccttctaaattttttttttaaatggggagaaatctatcatacgccttcactacaggaagggccccagtggacgcacagaatcaaagtttaccaaataaatacaatactttttttttttttttttttgagacggagtctcgctctgtggcccaggctggagtgcagtggcgcgatctcagctcactgcaacctcctcctcccaggttcaagcagttctcctgcctcagcctcctgagtagcattataggcacctaccaccatgcccagctaatttttctattttttagtagagacgagttttcgccatgttgaactcctgactgcaagtgatccacctgcctaggcctcccaaagtgctgagattacaggcttgagccaccacacctggccaaattcaagagttttaatactaacttccttgccttttgtagaattcgcttctaaatattttcattatttttattcatgtcaatgttacatgggtacagagtttcaaacaattccgctgagtctgttgtgaaaaacaagtcccattgtctccctctctccatccttttttcttttgctttcttttagtgatagagtctcccgctacattgcccaggctggtctcaaactcctccgccatccttttcttacgtgctaatgctacataaaaatctctttcttcctgtcttcctggggtttcaggagttacagttatgtatgtattcacacataccattatctggaagccattctctcataatttagaagggatatgggagataaattaaacagctgatattaaaaagctgatgctttttctgtagtaaacaacacatttaaaatcaccctctgaccatacacaaatttggggttcctcctaacaaaatcccagtgttatgtcatctaagcatttgaagggctcactatgactttgagtgtggagagcagtctttgaatcctctatttttctccttctttgcctttcccttgttcttctatgtgttctctacacctatcaacaaatcagcattgaacagtgagtctcaccaggcatacctgagaggagagaatttacagactgactatagggatactgagtcttaagacttttttttttttttttgagatggagtctcactctgtcgcccatgctggagtgcagtggcacgatctcggctcactgcaacctccgcctcccaggttaaagcgattcttctgcctcagcctcctgagtagctgggactacaggcgcgcaccaccacgcctggctaatttttgtatttttagtagagatggggtttcaccatattggccaggctggtctggaactcttgacctcatgacccgcttgcttcagcctccctaagtgctgggattacaggcatgagccactgcgcctggcctgtcttaagattatttcacaggttgtaggtgggcaggaaaaagagttacttccttggctgtccttctgtcttccagagtcacagctaaagaccagcgacaaaactctctagtcagttaagataaaggcccctacatgtgaaatacagatgacttattctgcactgctaagtgaatgaaatgtgaaacacttgcttataaaaacaaacttttcttccacccgggcatttccttggctatcatttcataaacacaaataagcctgaactttggtcacatctagagtttgacctaactgtatacccttagtgttatgtgctggttaattacaggttgagcaaccctagtacaaaaatctgaaatccaaaacactccaaaatccaaaattttttgaacacagacatgatgccacaagtggaaaattccgtatcttaccttgtgtgacaggttacagtcaaaatatagtgaaaactggccaggcgcaggctcacgcatgtaatcccagcactttgggaggctgagatgggcggatcacgaggtcaggagctcgagaccatcctaacacagtgaaaccccgtctctactaaaaatacaaaaaattagccgggcgtggtggcgggcgcctgcagtcccagctactcggaaggctgaggcaggagaatggcatgaacccaggaggcggagcttgcagtgagccgagatcacgccactgcactccagtctgggtgacagagtgatactctgtctcaaaaaaaaaaaaaaaaaaaaaaaaaaaaaaaaaaaaaaatatatatatatatatatatatatatatatatgtatagtgaaaactggccaggagcggtagctcacgcctgtaatcccagcactttgggtggccgaggcgggccatcacttgaggccaggagtttgggatcagcctggtgaatatactgaaacttcgtctctactaaaaacacaaaaaattagctgggtgtggtgacacatgcctttaatcccagctactagggaggctgagacgcaagaattgcttgaacccaggaggtggaggttgcagtgagcagagagcatgccactttactccagcctgggcaacagagtgagactgtctcaaaaacaaaacaaaaactctctctctacacacacacacacacacacacacacacacacacacactcaaaatttaatgcacaaaagtattaaaaatattttataaaactaccttcaccctaagtgtataaggtgcaagtgaaacaaatgaatttcatgtttttagacttgggtcccatccccaagatatctcagtatgtatatgcaaatattccgaaatctaaaaaaattccaaaatccaaaatatttctggtcctaagcattttggataagggatactcaatctgtactgacttgaaagttgaatatatcagaagggaaacaaaacatcagacaagagaaggtttacagggtgaaaaccaaaacctgaagcaagtttctttcaacctctggtgaatgaaaccatgatttcaaatacttactttaaatgaaaatcaagccataaggagactttagtcccacaaatgtactactggtcccctgacagtggtttctgcattagactgggttggtacattgaattaaaaagtgaaaacttgggctgagcacggtagctcacgcctgtaatcccagaactttgggaggctgagataggtggatcacctgagctcaggaatttgagaccagcctgggcaacatggcaaaccttatctctacaaaaaatacaaaaactagcggggcatggtggcatgtgcctgtggtcccagctatgcaggaggctaaggtgggaggagcacctgaacccagggaggtcaaggctgcagtgagctgtgatcgcgccactgcactccagcctgggcaagagagtaagaccttgcctcaaagaaaaaacaaaacaaaacaaaagactgccaaaatgatgagtgcaaagtgcattcattaagataagacaaggtggaggccgggtgcggtggctcacgcctgtaatcccagcactttgggaggccgaggcaggagttcgggaccagcctggccaacgtggtgaaacctcgtctctactaaaaaatacaaaaattagccgggtgtggtagcaggcacctgtaatcccagctacttgggaggctgaggcaggagaactgcttgaacccaggaggcggaggttgcagtgagctgagatcgtgccactgcactccagcctgggcaacagagcgaaactccgtctcaaaaaaaaaaaaaaaaaaaaaaaagacaaggccaacgggcgtggtggctcacgtccgtaatcccagcactttgggaggccaaggtcggtggatcacttgagctggggagttcgggaccagcctggacaacatagcaaaacctcgtctctacaaaaaaataaaaaattagctgggtgtgggggtgcatgcctgtagtcccagctactcggcagactgaggcaggagaactgcttgagcctaggaggtcaaggttgcagcagctgtgaccgtgcatgccactgcactccagcccgggtggggaaaaaaaaaaaaagaaagagataagatgaggaaaatataacccctatctattactttttctgaattcaaggattctgaattatatctttagactaagaaaaataagtaatattcactgcatggcctaattttacctgtcattgatttgctatttaacctcgagcaagtcacatttttccatctgtatatgtgaacacaggcattttgcctacattttgaactttttctttttcttttttttttttagacagggtcttgctctttcgcccaggctggagtgcagcagtgtgatcttggctcaatgcaacctcctcctcctgggttcaagctattctcctgcctcagcctcctgagtagctgggattacaggcacccgctatcatgcccagcaaatttttgtatttttagtagagacaacagtcactatgttggccaggctggccttgaactcctgacttcaagcgatctgcccgtcttggcctcccaaagttacaggcatgagccactatgcctggccttctttctctttttgttttttttttcgagacaaagtctcactctgttgcctaggctggagtgcagtggattgatcttggctcactgcaaactctgcctcctgggttcaggcaatttttgtgccacagacacccaagtagctgggactacaggtgtgcaccaccacgcctggctaatttttgtatttttagtagagacagggtttcaccatgttgtccaggctggtctcaaactcctggccttaagtgattcacccacctcggcctcccaaagtgttaagattacaggcgtgagccaccgcacctggcctaaaatgttttaaagcaatgtttcaatactgagtaaaaaactaaaaatgggaggtaatatcttagataggaggcactcaaattattgattaatgacctgagcatgctgacgtgtaggccatttcttcttaatcttctctagatcaggcaattgcaaggaagaaactcatggaatcgctactttccagaggtgacatgggaggccaagccaaatggagaaagcctgaaataacagcatatttataatgagatataggcatggctttcacatatttgagtgattggcatagtaacacaaaagtactttggcataaaaggaaataaaagacttctgggtgactatggagaacattctagggacaaatttgcttcagctcattaatctggtaacaatgctccctctgttcctgccattttggctctcttaaatatatataacatgaatatgtgcatatccatctgtgtattgctatcttactgactgctatcagttctggaaggtcaatgattaggaattcaatgatgatacaagtatacaaggaagacttagagttcccaaatctaattgaaatctggaaattctaaattctctttgacattctgttcccctgtcatcctcactggctggctggctgacaagtcaaaagaggctcctgcagtgggaatacagagttcaatgagctgtgcattcagggccacagaggaggagaatacaagccatacacatacagagaacccaaacacacaccacatccccattcatccactggcagaggacagagacttcttcattctgaatctcccactggcattcaagaattgcaagttctgtacaaactaggaggtgacagccacaacaaggggtcactgttactgtttccttttatatgtcttctaatcatcgtcagggaaactgtattacttacaagttttgttccttgtgctagttattgaagcatctctcggactccagagctactcttctatactatgtgttgtggggcccagactcagcaggctgtgagctgatacttccctaagagttacctgttgtctttaactcacatacaccatccataccacacacacacacaaacatgcaccacacacacaaaccatgcatacacacacaccatacacacttagaccatcactcagtgatatcggatttttttttttaacttgggttttaattaggtacataaatagcaacatgagaatgaggagttctaaggcttgtacattatctctaggtgaagggattccaggttagtttgcttgtaggatgatttcacagaagataacagaggtctggtctagtttttcctgaagaagaaagccaatttaatacattcaatactgacttctatgccatttttctgtagaaatactgatttattctatggagtttccaatgtttacctataactaaaagaaagaaaagaaaaacataagtaactgtgccagaaaaaattttgcattatgaaaattcttcagatttaaatagagaaaccaggccaggcgcggtggcccatgcctgtaatcccagcactttgggaagccgaggcgggtggatcacctgaggtcagaagttcgagaccagcctgcccaacatggtgaaaccccgtctctactaaaaatacaaaaagattggctgggcatggtggcaagtgcctgtaatcccagctacgcaggaggctgaggcaggagaatcacttgaacctaggagacagaggctgcagtgagctgagatcatgccattgcactccagcctgggcgacaagaatgaaactccatctcaaaataaataaataaatagagaaaccatagaaaatatttacatcaccattatatgaccataagaaacatgagccagagaaaactgtaattattcccattttaaagacagttaaactaagaatcagaaaggtcgagtgtggtggctcatgcctgtaatcccagcactttaggaggccgaggcaggtggatcatctgtggtcaggagttcgagaccagcctggctaacatggtgaaatcccatctttactaaaaatacaaaaaattagccgggcatggtggcgggcgcctgtaatcccagctaatcgggaggctgaggcagtagaattgcttgaacccgggaggcagaggacgcagtgaaccaagactgagccactgcactccagcctgggcaacagagcaaaactctgtctcaaaaaaaaaaaaaaaaaaaagattttgtgttccatcaacattacatatacactacattcagatcctcaattggctgtgtatctgagtgtaattaaccaactagatggatgaataaataaaaaacaaatgcctaaatggcacagtacacatcacatctgaagattaaacaactacatttccatctatctgctggaaagcatgattacatcaccctcagtttgatgtgtaattttcctcgcatcacccccatcatacttttctggaataaaatacacatatagtcaaagacatgtcaaagacaaactgagtcttctccagattgcttttttcatattttttttttttttgagatggagtcttgctctgtcacccaagctggagtgcagtggcgtgatctcggctcactgtaacctctgcctcccaggttcaagcaattctgcctcagcctcccaagtagctgggattacaggtgcccgccaccacacccagctaattttttatatttttggtagagacagggtttcaccatgttggccaggctggtctcgaactcctgacctaaagtgatctgcttgcctcagcttcccaaagtgctgggattacagccgtgagccaccacgcctggctttttttcataatttgtaatgaatatactcagcaattagagatttttttttttttttgagacggagtttcactcttgttgcccaggctggagtacagtggcgtcctctcggttcaccgcaacctccatctcccgggttcaagcaattctcctgcctcagcctcctgagtagctgggattacaggcaggcgccaccacgcccggctaattttttgtatttttagtagagatgtggtttcaccatgttgggcaggctggtctcgaactcctgacctgaggtgattcacccgcctcagcctcccaaagtgctgggattacaggtatgagccaccgtgcccggcacaattggagatttctaaatattttagaggccagtgactattcacttgatcttttaatatacaaccaaaaattcttaaacatgtaaactactagcttattttttctatctcagtttattaatctgcttttgtcttccccaggaatttgatagatttattgcattgttaaaaactaaaaactggaaacaacctatgttggtaaggattaagtagatcatggtagtccatactaggaaatcattaagcaactagagaaggaatgcgtagctctattaagtactgacagggaaatacttacacaatatgttatgtaaaacaagttcattcattcatcagcatagattaatatagtactgtctatggcaaaaaaaaaaaatgaacctaagtctaattaagccttcggatccaactataagtttatgggaaatatagagaagaaagaaaccaagagataaacagaatgatactaaatggatacattcggccacagccagaacatgagaaattctttttttcccctcccagctcaatccttgtagaaaacaggaattctaaaggacaaataagccaggtttttcaacagataaatagcaagggacaatgagggagcggaaactattacagttctaagagacctatcagtcaaacacaacaggcagatcttgtttggatcctggttcaaacgaaccaactgtaaaaagttattcatgaaacaaccaggaaaatgtgtacattgaactggatattagatgatgttaaggaattagtgcaatttctttctttctttgagacggagtctctctctgttgcccaggctgggagtgtgcagtggcacgatcttggctcactgcaacctctacctcccgggttcaagcaattctcctgcctcagcctcctgagtagtttgaactacaggcatgagccaccatgcccggccttaatttcctttttttcttttttcttttttttttgagacagagtctcactctgtcacccaggctggagtgcagtggcgtgatctcggctcactgcaacctccgcctttcgggttcaagcgattcccctgcctcggcctcccgagtagctgggactacaggcgcacgccaccatgtctggctaatttttgtatttttagtagagacagggtttcaccatattggccaggctagtctcaaactcctaacctcatgatccgcccacctcagcttcccaaagtgctgggaccacaggcgtgagccaccacgcccagccccagcctaatttcttttttttttttttttccccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaaaaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcctaatttctttatgtatgataatataattacaattatatgccttcagtaagttttctgtgcagctactcagaagggtgaagtgggaggatcacctaaacccaggagttgaagtccagcctgggtaacacagcaagatcccatccccccagataaataacagtaaaaagaaagttttctgtgaacttgtaaaacaatatgtggaatatgatcccattttgtcaaaaaaccaaaaacatgcatgtatgcatgaatatattataaatgtataaataaatttatttaatttataaataaattttaaatataaataaatatatatatttgtttttgagacagggtatcactctgttgcccaggttggagtgcagtggagtgatcatggctcactgcaacctctttctcccaggctcaggagatcctcccacctcagcctccaagtaactgggactacaggtgttcgtcatcacactcagctaatttttttaattttttgtagagacagggtttcgccatattgcccaggctgttctcgaactgccagactcatataatccacctacctcagcctcccaaagtgctaggagtacaggtgtgagccactgcacccggcctatctatctatctatctatctatctatctatctatctatctatctatatttaaaagtctggaatgatataccaaactattaacaaaaattacctctggaaaaaagaataaaggggccagatgtggtggctcacacctgtaatcccagtactttgggaggctgaggcaggtggatcacctgaggtcaggagttcgagaccagcctgaccaatatgctaaaaccctgtctctactaaaaaatacaaaattagctgggcatggtggtgcatgcctgtaatcccagctacttgggaggctgaggcaggagaatgacttgaacccgggaggcctcagaggctgcagtgagcaagattgctccactgcactccagcctgggcaacaagagtgaaactctatctcaaaaaaaaaaaaaaaaaaaagaaagaaagaaaaagaaaagaataaaggataagacaagcttttttgttttgtttttgagacagagtttcactctttttgcccaggctagagtgcaatggcacgatctcggctcactgcaacctccgcctcctgggttcaagcgattctcctgcctcagcctcccaagtagctgggattacaggcaactaccaccatgcctggctttttttttttgtatttttagtagagacgggctttcaccatgttggccagggtggtctcgatctctcgacctcgtgatctgcccaccttggcctcccaaagtgctgggattacaggcgtgagccaccacacccggccaagacaagcttttaaaacagttagctaaaaacattttttacaaccaacacgaatcacttttataattaaaagctacacctcctccaataaagatctaaaaacaataaagaatgaagtcaaggttgtgtatttcagcaagctgaactctggtgcagagtatctttgaaaattgaaatggatatttacctaatttccctttattctatgtctttttcattgtccctgtacagaaatatatccattctggctgacagggatttaaaaaaagagagaaatataaccatattaaaagtcaagtctctagaggacatgtgtcactctgtggctgctcaccctccagtcatccttctaatggcacatcccatgcatatctggccccattcaccagagatactgattctggggtgccctttgccttttaccaagctccccgggtaatagtttgtatctgagaacatactgatgttgggttactgtatgaacagctatgctgtgaaagaggaactggatttgttttctgtgaccactaaggagacatatttttgcttagcagaggaaacagcttccaaaaactcagaattgtcccaggatggctgccccatagggtgagtttcccatcagtgctggtgtaaaagaaggaacatacagggtttcaggggagtctgcttgaggctgggggttgggccagataaccactctcaaattctcagtttatgtgactctttgggtctccaaaaatataaagaaagcttgaggaaaaaagacccttcaaactcagggttttcataaattttaagtaagggccatgatttacaataaatgtaacaccaattttcaaaaaattttctgattataaaatgcatactcattgcagaaaattttttaaatacagaaagttataaagaagaaaaaaatataaaaatcatcatgccactgaaagatacacactttctgtcgtatctcctggcttcatcccctctataaacatatcacactacctttttttcatttaacaataattgtgcacacgttcccatgcaattaaatactgtagaaacagaataataatattcttctttatagatataccataattaagccattttcctgtagttgaatatctaggttgcttccaaattcaattacagtcttctaattaccaggaaatcacaagtgctattatacaatttttcatatatacacaaacaatataactagtgttttgagcctctctgtaacagtcatgcattccagtgttcactgagtattagataaatacaagtgtacttactataataaagtgttgtttgaaaaaaacctaaggaataatgacacttttcaattgtttgaaatacatttgtagacaaatcccaactgtctggttctagcttgtctaaaaaacccaggtaacattagtggaacaaacacaaataagtaagtcacagcatttaagcccagaaactaaaagatggaataaaatattttcacatcaaattgaaactgttataattaattaaattaaattaattaaaaacaagtcatttcagctggcactacaatgctgaaaataatcacagaaatttcttgttttttacctgattaagatggcagagcatggagttttctacttagttccaggtgaattcttcacatttcctggcttttaaaacaaaagaaagagcttgaatgcagtttgaaaagaaatagtgcaactccttagtgtcctgagtatttggctgaacatgaacattaaaaattattatgggggacagggtcaaaccattttattgaggacttggggggttgttgaagaaaggctgaggaggacaatgagatcccacattctcgcagttaccgaccattaaatattattttactgcaaagtgatccatctgtcagtaaattgaagaagttactagggctctctgagggccctactgtagagtgacttgggcagagagagcaggaaataaagctccattaatcctcattatgcagattcagccaaacagttgattctaattaaaaaatcaatatatcttccttttatttcctgaaataaaggttttacacctatgggaaggcttcctgtaggtatttactccatgcattattcaccattatccaccataggggccaatccacaaaacatgtttactctgaaagaagttagaccacacccattctgcccagtggccctccgggaacatataattaggccatgtaatccataagaagcagtgtaggaaaagcttctagtgggaaaagttcacgtgctaaacttttaaggccttactttcttttctatacgttttttagactttaattctgaaaacacattaatagtcagagatcagatggcagtctgaaaaacaggaggctgcagctgggcgggccatgggggctaagattctgttgtatagacttggagcagtttctcctggtgcccctctttcagagttattcatggatgaaggaagaggaaaaggtgagaaagcaggagcacgtgactaaccctgtcatttcagagcatggtttctaggcaactttggggctccctggagtggctgagaactggtctataagtactgttttatacccgttgtcccaacataattaatagtgtcccctttcactctcaagagtatcctggtttgccgggcatgttggttcacgcctgtaatcccagcactttgggaggccgaggcgggaggatccattgagcctgggaattcaagaccagcttgggcaacatagaaaaagaagtttaaaaaaaaaaaaaaaaaaaaaaagagtatcctggttttgatgataaagtatatggtcaccacatccacttgatgatggagttctgggaaacaaggccatacgaactgcttggcggaccaatgatcaacatacaattctcaggtctacttgatgctctgaacaagagtgctacaggactgagaatctgtgcccttctcctcctccagagccactccccaccctgcctcctcacatgcatgcacacaagcgaacacacatacccatatgtgaacacacacccacctacaacccagaggcctttttgctgttgctcgaaattgacaaactccctactgggacaagacctttgcaaaatataccccactgaccgagaccagacaatcccaatttttgcctagctaaatgttattcatcctttacatcaaggctttctttgtaccctgtccttcaatttagcagaaccttctattccctttcatagcactcatgtacttcctgattgtgtaattatttctttcatgtttgagtctttcattaacctgtaagcttcatgagggcacaatatccctagggcctcctagcacacactattcaaatatttgttgcataaacaaatggaaagccaggggcagtggctcacacctgtaatcccagcacttcaggaggccgaggcgggtggatcacttgagcccaggagttcaagatcagcctgggcaacatgctgaaatcctgtctctaaaaaaaatacaaaaattagccaggtgggatgacacatgcctgtggtcccacctactcaggaggctgaggtgggaggatcacttaagccagggaggttgaggctgcagtaagctgtgactgcacaactgcactacagtttgggcaacagagtgagaccctgtctcaaaacaaacaaacaaatggaatggggtagaacttagagatctgatgaatgtaaaaaagcttgggtttctattttcttaacacatccatgaacacgaataacaatttctgttagcaaaattaaaacttaaaaaaaaatcaaaacattgatttctaattagtatgactgccatgtgaaggctgattgccagccaaacctttgaggtatagcagcctactgaaatgtctgggtccctcaccagactaatgaagaacaagaagagagaaaaaaaggcttataagggccagtgagataatcatgtccaacaatcgggtctggcataaaaacaaggtggttctcggcagggcgtggtggctcacgcctgtaatcccagcactttgggaggccaaggtgggtggatcacctgaggtcaggagttcgagaccagcctgaacaacagggagaaaccccgtctctactaaaaatacaaaattagcagggcatggtggcgcatgcctgtaatcccagctgctcgggaggctgaagcaggagaatcgcttgaacccaggaggcggaggttgcagtgagccaagatcacgccattgcactccagcctgggcaacaagagtgaaactccatctcaaaaacaaacaaaaacaaacaaacaaaaaaacaagttagttctctacttaaatacagtttaggtctgaattaacatactgcttgccaaatacttccaatgatattcttatatattctactatctatactcgccagtacctcaatctcaaaaaaataagatgctaaattcacaagcttttttatcttttggacaataagaaaatgagcacacaaaagcattcttctgattcaggaaaacaactttgttgctaggaaaattttcttgtttggttacatatcacttatagtataacaaaacagcacagtccaatatctcattaaaaaaatattgagcccatccaccaccctgtcacaaatcagatctctcttggcagagaactccaggatctcagacaaaacaacattctgacttcaaaaaacagttcgtgatttagcacaagccagaaatcatttttttttgcattttcagacagagaaagttttatctagaatattttgtaactcattttcatacatatctgatttcagtttttattttcttaccacgtccatgaacacaaatgacaatttctttttttttttttttttttttttgagacggagtttccctctgtcacccaggctggagtgcagtggcgcaatctcagctcacgtaacctctgcctcctgggttcaaacgattctcctgcctcagcctcctgagtagctgggattacaggcgcccactactacacccagctaattattgtatttttagtgaagacagggtttcaccatgttggccaggctggtctcaagctcccgaccacaggtgatttgcctgcctcggcctacaaagtgctgggattacaagcatgagccaccgtgcctgggcacaaatgacaatttctgctagcaaaaccaaaactttttaagaaaatcaagacactgatttctaattagtatgcctgccatgtgaaggctgattgccagccagccaaacctttgaggtacagcagcctactgaaatgtctgactccctcaccagttgaattattttcaacaattacttaacttctccaaaatgcagtttcctcacttataaatggggataataatagaacccacctcaaagactcttcctgagcaaagagtttagcgccaagggccaagctcacagcaagtaagtgctcaataaacattatctatcctatatggcaggccactttattttttggatgaagaaaataaaaggtaaggataaatgacctgttaaagaccccaacacaattctagttcacttgatgaggtaggcagaataatggcccctcaaagatgtcttctatttctggaacctgtgactgttacctcacacagcaaagggaaattaaggttgcattggaattaagtttactaatcagttgcccttaaaatagggagatgatcttggattatctgggtgggcttgattcaagcataagagtgcctgcagtctaagagggaggcagaagaagaggtcagaagggggatctgcaaacgacttgctgcaggcttcgacaatagaggaaggaagctggaaacagccctcagccagcaaaacagaccttggtcctacagcctcgaggaactgagttctgtcaacaatctaaatgagcaggaaagaaattcccccctagggcctctagaaaggaacgcaaccctgctgacaccttgatttagaattggacttctgacccacagaactaagataatcatttgcactactttcaacctgtaaatttgcagtcatttattttggcagcaatggaaaactaaaacaatgacataaggattcctgactacagggtatggttccattttctatcagtggacattatcttctcaggcagaagcgaaaatgtgcagtatcacatgagtggtggttgatgactatcatgtggctagagtccagccatttcatatgttcctcacatgagataaccttatttaatcctcaaaacagctccaggaggtactatgccagttcccacagagctggagtaacttcccaaggtttcagggctagtaagaggcagaggtggggtaggagtctggtgctcccgctcctcttagtccactggacaacgctgtatcctgcccactgataccaagagtgcattcctttctaaagaggagatgacattattcaggatttctaacttttcattttggtaaataatggtgtttttaaaaagaaagaaaaaatcatttcaaaatcatttcctaatacctgtagttcttagaattttagacagcaaaaaattacaaagcacaaactcataactttatggaaaacccatcaagctgtcatttaaaaaaaatacagtggtaagaatacttaacatgacatctgccctcttggcagatttttaagtgtacaatacggtactgttatctataggcacagtgttgtgcaaggggtctgtagaacttattctctttgcttgactaaaactttgttgattaccaactccctatctctccctcccccaatccctggcaatcgccattctattctctgcctctatgagtttgactattttaaatacctcatacaagtagaatcatgcagtaattgtccttctgtgattagcttacttcaaagatgaacattttaaaactacatgacttactttcagccaaactttgccatgtttagagagccgaggaacttctaatggaggaagaaaaagcagggcatgtttactcagggtggtggctgctgcttccctttcattttcctgctgagccagcaagggcctgaataaaactattaacagctcagctttagaagttctgctcagttttcacattggtaacaggtttatgcttctttattaatttcctgccttttaaataattagtgttggccttcagcagtcattgtacaattctgtgatagtaatttgttgcattaaaaaaaagctagtgaaaaactaaaatatgatatttactgagacatactgctgtgtttagctaattataagacaactctaagctgggtgcggtggctcacgcctgtaatcccagcactttgggaggccgaggcagggggatcacctgaggccaggagttcgagaccagcctggccaacatggcgaaaccccgtctctactaaaaatacaaaaaaaaaaattagccaggcatagtagtgaatgactgtaatcccagctacttgggaggctgaggcggaagaatcgcttgaacccagaaggcggaggttgtaatgaaccaagatggcaccattacactccagcctgggcgacagagcgagactccatctcaaaaaaaaaaaaaaaaaaaagacaactctagtcgggtgcagtggctcacgcctgtagtcccagcactttgggaggctgaggcgggtggatcacttgaggtcaggagttcaggaccagcctggccaagatggtgaaaccctgtctctactaaaaatacaaaaattagccaggcgtggtggcgcacgcctgtaatcccagctactcaggagcctgaggtaggagaattgcttgaacccaggaggtggaggttgcagtgaacgcgatcgcaccactgcaccactgcactccagcctgggctacagagcaagactccatctcaaaaaaaaaaaaaaaaaaaagacaactctaaaagagccatctgtgaccctgaggactgacacccacaactgacctcctgacacccacaactggccttcatctctgatactgagaccttgggttaggactattctgaaagggtttcggattagcaatggacaatcaataaatatttcatgcttttattaagctcctagagtcaaagagtgaaaaccataatggaaaaggtcaataaatcaactacatgaagaacttcttctgatcatcaagacaccaaaactgaaaagacaagccatattgagaaaagacatctgcaaacatctggccaaaactattaatatctaggaaaaaaataaagaacccttataaatcaataagggacaaatgacccatataaaaagtggccaaaagacatgaacaggcatttcaagaagaagccaataaacctgtgaaaagatgctcaatcagggcaatgtaaatgaaaaccacgatgggaaattctgggaacatcttcacatgctagatagtgaggtaactatcacagactacttgggtcatgtcaagaggactcagagccaacttccactagcaaaatgggacagtttgaactttaataagaccaagaattacaaagcattcaaaactatcaaatatgtttaaatctataaacccgtaatgatttttaatttatttattattttaagaaacagggtcttggccaggcgcagcggctcacacctgtaatcccagcactttgggaggccgaggcgggcggatcacgaggtcaggagatcgagatcatcctggctaacacggtgaaaccccgactctattaaaaatacaaaaaattagctgggcgtggtgacgcgtgcctgtagtcccagctactcgggaggctgaggcaggagaatggtgtgaacccgggaggcagagctagcagtgagccgagatcatgccactgcactccagcctgggcgacagtgcgagactccatctcaaaaaaaagaaaagaaaagaaaagaaacagggtctcgctctgtcacccaggctggagtggagtggtacgaacacagcgctcactgcagcctcaaactcctagactcaagtgatcctcctgtctcagcctcccaaagtgctgggattacaggtgtgagccattgtgcccagcctataattatatatatatatatatacacacacacacacatatatatccatctctatataaatatatatatatatttatttatttatattatttttttgagatggagtttcactcttgttgcccaggctggagtacaacggcgggatcttggctcactgcaacctccgcctcctgggttcaagcgattctcctgcctcagcttcccgagtagctggaactacaggcatgtgccaccacgcccaatttttttgtatttttagtagagacggggtttcaccatgttagctaggatggtctcgatctcctgacctcgtgatccgcccacttcagccccccaaagtgctgagattacaggcatgagccaccgcgtctggccctatttttttgagacaaaatctcactctgtcgcccaggctggagtgcagtgacgcgatcatggctcactgcaacctctaccgcccaggttcaggtgattctccagtctcagcctcctgagtagctgggactacaggcgcgtgccaccacacctggctaattttttatttttagtagagacggggtttcaccctgttggccaggctggtctcgaactcctgacctcaggtgatccacccgcctcggcctgccaaagtgctgggattacaggcgtgagccaccgtgcctggccattatttttaaagaaaaactaacaggtgatcttctgaggaaagggaatgaattcattattttgaaactggataaataagagaaaaaaatcaagtaattatcttgtttttcctatataaactataactgggtaactagtagataagagaaggggttctttatcaaaatatttcagctaatttgagaaaatgaaacaatagaagcaaaatatcaccattttcttttctttttttttttttttgagacagagtcttgttctgtcaaccaggctggagtgaggtggcatgatcttggctcactgcaacctctgccttgcagcttcaagcaattctcctgactgagtctcctgagtagctgggactacaggcacgtgccaccatgcgcggctgattttttttttttttttttttttgagatggagtctcactctgtcgcccaggctggagtgcagtggtaggatctcagctcactgcaagctccgcctcctgggttcacgccattctcctgcctcagcctcctgagtagctgggactacaggcgcctgccaccacgcctggctaatttttttgtatttttagtagagacagggtttcaccgtcttagccaggatggtctcaatctcctgaccatgtgtggctaatttttttgtatttttagtagagctggggtttcaccatgttggccaggcaggtttcgaactcctgatctcaagtgatctaccctcctcggcctcccaaagtgttgggattacaggtgtgagccactgcgcccggccaatatcaccatttctatcccccaaagattcaatgggtctaggcattgagcatctacagctgctaaaaccaataaaaacaaagcaaaaaccagacttatgtgcctacgtggatctagagcattgccaaaaggatcaaacaggatctggttcaagtagcccgtgcatccagctgccaatgtgcagggagtacagagaacacgttaaactatagcataaatgtgtaatcagcaaaacccaaaccgttggaaactctataggtgaaatgtgccagactgttttaacagataaactgtaaggaagtcaactccaaaagatggaaggggagcctgtagattaagagagacttaaaaaaaaaaaaaaaaaaaaaaaaaagttcgggcatggtggctcacacctgtaatctcagcactttgggaggccgaggcaggtggactgcctgaggtcaggagtttgagaccagcttgtccaatatggtgaaaccccatctctactaaaaatacaaaaattaggcgggggcggtggcgtgcgcctgcagtcccagctactcgcgaggctgaggcaggaaaattgcttgaacccagaaggcagaggttgcagtgagccaacatcacgccactgcactccagcctgggcgacagagtaacactccatctcgaaaaaaaaaaaaaaaatcaaaagttgtttaaggcaagtacattattggggcaactagggaaatttgaacatgggctatatattagataacatttgtgtaaataatgaaatgccaactttcctgagtacaataacggtattgtgatcatataaatgaatgtccacgttctttggaaatacatgctgaattagatacagatggaaaatgcaatgatatctacaattaattctcaaatggttcaggaaaataaaatatactcgtgtgtatgaacaccatgcataggtgaaaagatagattatgcaaatgcagcaaatgttagtgaatctaagtgaagggtatattcattgtactagtcctgcacctgatctgtagttttgaaattttctcaaaatgaaaattgggaaataaagtaaagccacatacacatatactccatgatgaaaaactcttttaaagccatcacactggcaaaaatggtaacaattacttggcatcatctagtaaaactgaagatatgcagaccctatgaatcaggaaccctggtctagaaaaattcttcacaaattatgaagccatgctgtgttgtaatagtaatatactgaaacccacccaaggagccaccaacatgggtattttcccataaagaaaatatgaccaggcgcagtggctcatgcctgtaatcccaacactttgggaggctgaggagggcggatcacctgaggtcaggagtttgagaccagcctgaccaacatggtgaaaccctgtctctactaaaaatacaaaaattagccagggatggtggcgcatgcctgtagtcctagctactctggaggctgaggcaggagaattgcttgaacccagcaggcggaagttgcagtgagtcatgactgcaccactacactccagcctgagcaacagagtgagactccgtctattaaaacaacaacaacaacacaaagaaaatagtctacagcagtgaagatgaatacactactgccatacataacccataaacaaaatgttaagggaacaaaacaagttgcaaaataatatgtagtaagactcatctagataaacttatatatatataatatgtatatttagacttaaatttggtatatttttataaaggcaaaaacaggcaggctcaacaatagtatttcagaatacagacatatatggttaaactggaagaaaagtttaaagaaaaacaagggaatgaaataaaattccagataatggttccctctggggagacttgggggtgaggggacccatggaagacttgaaaggcatcggtaatttccttttttttttttgagatggagtcttgttctgtcgcgcaggctggagtgcagtggcgcgatcttggctcactgtaacctccacctcccaggttcaagcaattctctgcctcagcctcccgagtagctgggattacaggcacctgccaccatgcctggctaattttttggtatttttagtagagacgggttttcaccatcttggccaggctggtcttgaactcctgacctcgtcatccacctgcctcggcctcccacagtgctgggattacaggcgtgagccaccgcgccccacggtaatttcctagttttaaaggtagataattggttggtatgtacatggtcattatagtgttggattttaaactatacatatgttatatattcttgtaacttaaaagaaagccctagactgtaccaagatgacaatatttctggacacacctatctttgcttcatagttctgacaaaaagttcattttaactgaagcagataaattcctcttaagtaaccaatgatgacagactgaaacactactttattggtagaagactcagcacaaacatttagaatcatttcgtaagagggaaaagggatgtggcagagcagcaaaatgccacagacctgtttgggatatttcagagtaatatacccccatgggaaataataccgttaagaattgtgccatcattcctaatttaaaaattttcagtgccctgttttatgtatgtatgtatgtatttagagaccgagtctcgctctttcgcccaggctggagtgcagtggcacgatctcagctcactgtaacctccgcctctcaggttcaagtgattcttgtgcctccgcctcccaagtaggtgggattacaggtgtgtgccaccatgcctggctaatttttgtgttttcagtagagacgggggtgcgccatgttgtccaggctggtctcaaacttctgggctcaagtgatccacccgtctccacatcccaaagtgctgggattacaggcgtgagccaccacacctggccagcaccctgttttaaacatagtgtccacagtttctctgactatgtacaaccaaaagccagtacatctgttacatgattagaatacaaacaattggccgggcacggtggctcaagcctgtaatcccagcactttgggaggccgaggcgggcagatcacgaggtcaggagatcaagaccaccctgcacaacatggtgaaaccccatctctactaaaaatactaaaccccgtctctattaaaaattagccaggcgtggtactatgtacctgtaatcccagctactcgtgaggctgaggcaggagaatcgcttgaacccgggaggcggaggttgcagtgagccgagatcgtgccactgcgctccagcctgggccacagagcgagactctgtctcaaaaaaaaaaaaaatatgaattagatgatacttaattgagactggtaattaaagctggacttgaaaaccaacttcctaacaagctaagaaacaaaaaagtccccttcatgaagcgtcccttaattcccttcaatgaagacaagatatcttcatccaaaaatcatacatttttgtgtgtgcctttcttctggcatttatcacattttatcttgtattttggtcatatgctttccttatctcctttactagattttgaattatttgatagtctatgaagagaatatactcagctccaaggccccagaaagattcattttccagggtagcttaaatcttagctctcattaaaaaaacaaaaacaaggccgggcgtggtggctcacgcctgtaatcccagcactttgggaggccgagatgggtggagcacctgagttcaggagttcgaggccagcctgaccaacatggtgaaaacccgtctctactaaaaatacaaaaattagctgggtgttgtggtgtgcgcctgtagtcccagctactcaggaggttgagacaggagaatggcttgaacccgggaggtggaggttgcagtaagccgagatcgtgccactgcactccagcctgggcaacagagcaagattccatctcaaaaataaataaataaaccaaaaaataaaaaacaaaaatccccctgaagcccatgaaatctaaagtggggggggtgaagcaagatcaacaaaaaacaatgccacttcattatatcaagtaattcctgaaatttaagaatattgaattttgaattaatagggccttctgctatttttcctttaaaacttgtaataaatatttaatgcagtcaacattaattttttgtatttttagtagagatgaggtttcaccgtgttagctaggatggtctcgatctcctgacctcgtgatccgcccacctcggcctcccaaaattctaggattacaggcatgagccaccgagcccgaccgttttttttttttgtttgtttgtttgtttgtttttgatacagggtttcactcccattcaccaggctggagtgcagtggggtgaacatggctcaccacaaactctacctcctgggctcatgagattctcctgcctcagcctcccaagtagatgggactacaggtgcatgccaccacacctggttattattttttttttggtagtttttgtagagacagggttttgccatattgcccaagctggtctcgaacacctaggctcaaagcgatttgcctgcctcagcctcccaaagtgctgggatttcaggcatgagccactgtgcctggccctgattttattaccttctattgagaacagacagctgtcaataaaattatccttggagagtaacaaacaggagaaagccttaagttctcaatgactctgaagaaggcaagggtataaagacagagagaaatgcaaaccaatcatgagctaattaaaaatctttaccacctcactctaaaaagatctgcatataaatttgggtagctttaatatctaatgtcttcaaatgaccagaaaatgttggcctgcttaactggtatcctaaccacagtccagctgcttctgcactgggctgaattcttagcacagtcagagaatgctgtttccaagccagaggctcccgcagccctcactttagctttggtgtgcgtgtgtgtctgcacagacaccacagtgagcactccggggagcctgggggactccctctggctttggtgtgcttcagtctgcagtcacaccacaatgaaggctcgcagttgaggcttttagtctcactttccacatttctgtctagggctgtttagagatttcttgatattttacttcctttcccatataaaatttagtgtgcatttgtttttttgcttgtttgtttttgtttttttgagatgaagtctcgctctgttgcccaggctagagtacagtggcgcaatcttggctgactgcaacctctgcctcctgggttcaagcaattctcctgcctcagcctcctgagtagccgggattacagacgtgcatcaccatgcccagctaatttttgtatttttttagtagagacagggtttcatcatgttggccaggctggtctggaactcccgacctcaggtgctccacccgcctcggcctcccaaagtgctgggattacaggcatgagccaccgcacctggccgcatttgttaaggaattttttaaaaaggaaaggaagcttccatagaaaatatcagagaaataaaacaaaaaacaatcaaaaaaacagggattgccaaaagactcttgatattggtatagaatttcctattcaagagctagtttaaataggctcgagaaggactaattcctttagaaaccaccagtataaaaattagtggggttttttttctttttttctttttttttttttttgagacagggcctcactgtgttgctcaagctggagtgcagtggcgcaatcatggctcactctatttagcccttaccttctgggctcaagcaatcctcccacctcagcctcccaaagtatgccaccatgcccagctaaattttttattttttggagagatagggtctcactatgttgcctaggctggtctcaaactcctgagctcaagtgatcctcccaccttggactcccaatgtgctgggcgtgagtcactgcacctggccaaaaaatgagtcttaagatttcactagaagattatttatgtaaataataaagagggcttataatttattctgttacttccaaatcccagttcaaaattctggattttaattctgagatagttatttatatgtatttttttaacttgtcaatgatttgaagctcagttatttatttttttttaaaaagtattttcattgaaaaatgaacttccttcaatctgtgatgtagaaggtatattaatataagaagtctaattcttccttagctggctgtgcctctgagtgcttagtagagacatgataccttattctctactcattcttccttatcagtgggaggaagggaatgttccaagcgaacataggcaacatttaatcggctatgtggccactaaaagagatgaaaggtgacaagttcttacaattacacaacttcttccctctgttgctcatgtactagacagcacagagaacgtggcctttagctggtagctagtccccaacatacgatggctcacaccctcagctgagctgagaagcctgggggataaacagaaacagcagtgctaaggaaagaacagaactcatgataagtgaaaaaccaagaggaagaggctctcaattatgtctttttcctgggagcatagtacattccctttgaattcagtttcaataagacttttaaataatacgctacacttagaggaaactaggaatacaatataatggaaaatatggtctaagactacggtggaatgcattgcattttatggtcaccacttatttggccctgctgataataaccaaatactcagaagttctactgctctaccaagaaaggtcacctgaaaaatctgagctggagacagaactagaagcaaacagaaaaagcaataaatcaacagggttatcaaatattttacaaaaccctagagaaaccacatatttaaaccaaaaggaagataatgaaaaagatgctcctcaccttttgaaagttctccttccacaaatcttctatgactatatatcctcgtaaaccccagtcatataatctctccccactgaccttaaaacaaaatagaaaagatcttaccatctgacccagcaatccctattattgggaataataatggaatataaatcattttactataaagatatatgcatgcatatgttcatcatagcactatgcataatagcaaaacatggaatcaacctaaatgcccatcaatggtagattttttttttttttttgagatggagttttcgctcttgttgcccaggctggagtggaatggcgcaatcttggctcactgcaacctctgcctcctgggttcaagcaattttcttgcctcagcctcccaagtagttgggattacaggcatgtgccaccacacccagctaattttttgtatttagtagagacagggtttcaccacattggtcaggctggtctcgaactcctggcctcaggtgatccacctacctcggccttccaaagtgctgggattacaggcgtgggccaacatgcccagccaatggtagacttgataaagaaaatgtggtacttatacaccacagaatactatgcagccaaaaagaatgagctcatgtcctttgcagggacagggatggagctgggggccattatcttaagtgaactaacataggaacagaaaaccaaataccacatgttcttacttgtaattgggaactaaaccttgacaacacatggacacaaagaagggaacagagaccgaggcctacttgagggtggagggtgagaagagggcgaggatcaaaaaactacccatcaggtactaggcttattacccgggtaacaaaataatctgtacaccaaaccctcatgacacacgatttacaataacaaacctgcacatgtacacctaacgctaaaagttaaaaaagaaagaaatttaaaaaaaaaaaaaaaagactcctactctggggacagccacatatgcttctcaacgagcaaccaagttcaccctctccactctagctatttactgcttaaaccataacaggctgaaataatgtttaattatttttatatctagggctggaagatgttactcactgttcctgacctggggctggagcagggacagaagcattaactatctgcctccaggactgttacaaacaatgttgagcaaatgctggaaagtactggtatttgtcatcaaagccatcaagctccccaagctggggccactggactctcacatacaactgtagcccaatcaaggaatctggattcaatactgtcatgaacaaccaaggaagctcagtctcaggtcagtctggctcagagtccaatttgggtgactgcactgctgtctgctcctggaactgagtttccatgtgatgtggtagttccagcagctaaagtccctgtgtccacaatctgcccaggacctcaaaacctagagcctgtcttgttcttaccagttcctgagggacaccatctctagagtcccactcactccagatatcacccttttcaggctacctactggtctccatcagtggttctcaaacaccataggcattaataacaaaccaccggagggcttgctaaaacacagactgctggcccttactcccagagcttctgattcagtcagtctggggtggggcctgagagtttgcatttctaacaagttctcaggtgatgctgctgcttctggtctggtaacacattttaagaatcggtggtacagctttatccatgttgcctgccaccgtgatagacctgcttgccagggtaccataagactgaggcttcaaggataagaaaggagcagccaactgaaagccccgaaaagggcactccaagcagaggggattacagtccccaaagtccccagcaaggaaagcaagggcaccagtactagggaggagtggaagtcagagtagtctgggtctacaataccaacgagagcaggttgtgaccggacatgcataaactgagtgacccataattatcagctttggaatttgagtctctagacttccatgtaagtatacaaaaaatgtatattaaatttttgctgatgaacattcaaacaatcacgcaaattcgtgttcaaattctgtgaacactggcattactggaagaagggccagaactgaggcatatagtggagaaaatcatttaaattttctgtattcatctatatgtacaaacaaattttagtctggtgttataagaactgcaaaataaaataaaattaagcatcagattcatacacacacaaacaagaatgagggacatcatggattacagagtttctcttacctgggcaaacacgatggcttgttgtggataatagagggaggcagctaatcccatgaaaccaggcggatacactagcttctttatttttgaacctgataaataaaaggttgtacacgccatcagatgattcattatcctcaccatcacaatttaccttatccatttaatacggaacaaggccaggcacagtggctcacgcctataatccaaaagctctgggaggccgaggcgggaggatcacttgaggccaggagtttgacaccagcctgggcaacatagtcagatcctgtctctacaaagattaaaataaaaaaattagccaggcgtggtagtgtgtgcctatagtcctagctacttgggaggctgaggtgggaggattccttgatcccaggagttcgaggttacaatgagctatgatcacacctctaaactccagcctgggtgacagagcaagaccgtgtctcttaagaaacccaaacaacaaaaccaaaataaccccaccactgaataagatttctttggtcctaaactgaaagaatgtgccaaataaagtcatgtgcaccaaaacgcttttgcactgctttattgagataaaattcatattcacccatttaaagtacagttcaatggcttttagtatattgacagaggtgtgtaaccatcattacaattaactttagagctttttcataatcactaaaagaaacccattagcagtcattcctcaactcccccgtaccgtccagccctaggcaaccattgatctactttctatctctatgtgtttgcctactctggatatttcttttttttttttttgagacagagttttgctcttgtcacccaggctggagtgcaatggcgcaatcttggctcactgcaacctctgcctctcgggttcaggcaattctcttgcctcagcctctcgagtagctggggttacaggcacacgccaccatgcccggctaattttgtatttttagtaggcatggggtttcgccatgctggccaggctggtctcgaactcctgacctcaggtgatccacccgccacggcctcccaaagtgctgggattacaggtgtaagccgctgcgcccggccctctgggtatttcatataaatggaatcatgcagtaaatatacggtcctttgtgactggcttctttcactcagcaccaagtgttttcaaaagaacacctttttttccctaagagagcagaaaaaaagattattttaaaaataaacaaatgagtattttggtttctagggtttatgttcttttatagcaatctggcttcctatataaatactaaacacaagcgttcttcttctcccctttctgcaaccccgttaaaaaaacagtaagaaaaaacattaataaacccacaatgaagagaaaatgtgtggaagggccactggcagaaaggaagtgtcaatcaattttcagaaaatggagagtgaacggaaataagaggacacactgccttgaaatcttgaaatcttgaggaggagtgcagcctcagagggagcagatctgtcccaggcagccccagggagattccagatccagagatggcaggtaccatggggagtggagatggcaaccagggagcaagacaagggcacaggacaaacgcaagtccgatgcatggaccagcatggcctttccttcccctatgccatcccagtacaaaactacccctggccaggaagtcacaccagttcaaaatgttaaaaaacccagtaaaccagggttactgggtgtggtggctcacacctgtaatcctagcacttggggaggtcgaggcataaggattgcttgaggccaggaattgagaccagctggagtaacatagcgagactccatctccatttcttttttttctgttgagagagggcctcactcggtctcccaggctggagtgcagtggcacaatcatggctcactgcagcctcgacctcccaggttcaaactatcttcctgcctcagcccctcaagtaggtgggacaagaggtgcaagccatcatgcctggctaattttttttttttctgtagtttttgtagacacggggtttcctcatgttgcccaggttggtcttgaactcctgagctcaagcaatccacctgcctcagcctcccaaagtgctgggatcacaggcatgagccagtacgcccagccccccatctctattcctttaaaaaaaaaaaaaaaatgagcctgatgcagtggctcacacctgtaatcccagcactttgggaggctgaggtgggaggactgattgagcccaggagtttgagaccagcctgggcaacttagggagaccacatctctacaaaaaattaaaaaattagtaaggtgtggtggcatgtgcctgtggtcctagctactcaggaggctgaggctggaggattgcttgagcccaggagttcaaggctactgtgagctgtgtctatgccactgcactccagcctgggtgataatttggatgttgttctctctgaatctcatgttaaattgtaatccccaatgttggaggtggggcctggtgggacgtgacctgatcatgaaggtggatttctcacagatggtttaacaccattcccttggtgctgtccttgtgcaacagtgagttctcttgagatctggttgtttaaaaatgtgtgacacctcccccacctctttctcttgctcgcactcttgccatgtgagacaccagctccccctttgccttccaccatgattgcaagcagcccaaggcctcaccagaagccgaggagatgctggtgccatgcttcctgtacagcctgcagaactgtgagccaactaaacctcttttctttataaattacccagtgttaggttatagcaatgcaagaatggcctaacacattgggtgataaagcaagatcctgtctcaaaaaaaaaaaaaaaaaaaaaagagttaaaacagtgggggcagggtatcactaaagaaacaccatggatttcctgctgagaaccaagagagctggaaggggtgagtatgtcagtgcctgagagaaaagccctcctcacactggccctgggtgcacccttgtatatggtcacttcctgcccagctcccctgaggtagaacctgcccgtcagtgggccccatgtacagacagggagttcttttttttttttttttttttttcccgagacggagtcttgctctgttgctcaggttggagtgcagtggcgtgatctcagctcactgcaacctctgcctcctgggttcaagtgattctctagcctcagcctcctgagtagctaggattacagacaccctccaccacacccggctattttttgtatttttagtagagatggggttttcccatgttggccaggctggtcttgaactcctgacctcaggtgatccgcctgcctcagcctcccaaagtgctgggattacaggtgaaagagttcttattagcatttcagctgcctcactttgaaacatgactggataaccaagaatcaccagtcatttgtggaaagcctgaaacataaaggagaaagaccaagacaagcacaaaggaaacagaagaacttcaaaacaaaactaaacctattactaagtatcatcaaataaattttaaaagccactacattaaaagaaaaaaataattctatgaaaaaaagaacattcaaagaacaggaaggagctcttggaaatgaccaaagcaaaaaaaattcaaaaggaacaaaataaaataatcaagaaaatataagagacacatagggtccttttaaataactcaattgctaattaatgcgttgaggaaggaaaaagaatgagagtaaattttcaaagatacacaagataggctgggcgcagtggctcatgcctataatcctagcgctttgggaggctgaagaaggaagactgcttgagctcgggagtttgagaccagcctgggcaacatggtgacacccggtctccacaaaaaaaaaaattagtcaggtgtggtggtgcatgcctatagtcgcagctactcaggaggctgagatgggaggattgcttgagcctgaggaggtcaagactgcagtgagccctgatcatgccactgcactacaacctgggtgacagagtgagatcatctctcagaaagaaaagagaagagaagagaagagaaagggacgggacgagaagggaaggaagaaggagggaagggaagggagaaggagggaggggagggagggatgcaggggatggaaggggagggaggagggaaggggagggagaaggagggaaggggagagagggaggggagggcagggaagggagaaggagggagggagggaggaaaagaagatattttccttcagctggatgctgcaagccgccatattgtttgggcaagaatgaaaacactatatccaaggctgggcatggtggctcatgcctgtaatcccagcactttgggaggctgaggcgggtggatcactggaggtcaggagttcaagaccagcctggccaacatggtgaaaccccatctctactaaaaccacaaaaattagccaggcgtggtggtgcacgcctgtaatcccagctaactgggaggttgaggcgtgagaatcacttgaacccagaggtggaggaggttgcagtgagcggagattgtgacactgcactccagcctgggtgacagagtgagactccgtctcaaaaaaaaagaaaagacttctatctagtcacagcaccaaagaaattcagaacactaaagattcacagaagatcttcaaagcttccaggaagaaaaaaaaaatgtatcacctgttcagaagcagcaaatatccagaatggctactgactctcacatctacaacgccagatgctagaatacatggctttgaaagttttgatggcaaacaaaattcagtgcccaaccaaactgtcacatggtatgagggcagaaagtgattttcagacatggaaggtcttgggaagtttacctccaacatacgcttttttgaaagtgacttaagcatgtagttcaacagcacggcagagtaaaccaaggagaagatgacatggaacccaggaaaagggggcttaaacccaagaaagtgtgaagaagaccagtcccaaaacaagaactgtgttgaagtctcaggccagattgtaggaggatatagagctgtggagcaagggaaatggacagaagagacagcaggacacagagcctggagaaacctgagaatgaggttaaaaaaaccagtagaggatgaaactagagaatacacatggccttgactccactgagaggcatagtgttttttgctgtgggacccatatagatgctagcagaatgtgtgtgttattgatttttttttttttttttgagatggagttttgctcttgctgcccaggctggagtgcaatggtgcaatctcggctcactgcaatctccacctcttgggttcaagtgattctcctgcctcagcctcccaagaatctgggattacaggtatgcgccaccatgcccaaataattttgtatttttagtagagacagggtttcactatgttggtcagtctggtctcgaactcctgacctcaggtgatccacccacctcagcctcccaaagtgctgggattacaggtgttagccaccatacccggctgatttgtttgtttgtttgtttgttttgagatggggtctcgctctgttgctcaggctggagtgcagtggtgcgatctcggcttgctgcaacctctgcctcccgggttcaagtgattctcctgctttcgcctcccaagtagctgggattacaggcacccgccaccacgcctggctaatgtttgtatttttagtagagacgggtttcaccatgttggctaggctagtcttgaactcctgacctcaggtgatacatccgccttgaacttctgaagtgctgggattacaggtgtgagccactgtaccccgacagaatgtgtacattaatccttaaacggttctaatcacataagtactgtttattggctttaaaactttaaacagagaaatccccaacgatggaactgggactgctgaagagaatacaaatgttatcaacctagactattaatgatttactgtttctctcctgatcctgttgcatgaattgaaagggtataattatcctagaagagaaaagcctgtgatatccctgcatatggcccctcccctgcccccatccacttgaagcagctcacccaagtgaggaccagggaaagagcagccaacctgccacccagtcatttctcactcctccagggagagccgagaagtggcagctctcgggcctccagctcctgctggttcacacaatgagccagagacccaagaacttcaggaaggaggtgtaatcatactcccctgcccccacctccatgccctatctcccaagaggccagtggtacaggttgtcactatcagcactgccaggggcggggggaaccactggtggccaatgctggggagagccaccagaaggcaacaatagtgtcaacaaccacgtgtcatcttggagtggtctggctgggcccacttcctctgaatggacatccattcacctctctgagagcctcttgtcaccaccacagttgtggcaatcctcaacaactgaagcagactaccttagcagatacgctcaagaaaccccaccaggccaggcacagtggctcacaactatgatcccagcactttgggaggctgaggtgggaggatcacttgaggtcaggagttcgagacaagcctggtcaacatggtgaaacctcgtgtctactaaaaatacaaaaatgagctgggcatggtggtgcacgcctgtagtcccagctactcgggaggctgaggcaggagaatcacccgaacccaggaggcagggttgcagtgaggctgagatggcgccactgcactccagtctcggcaacagagcaagactgtctcaaaaaaaaaaaaaagaaactcctatcaggagggaccttctgcacccacccaccctgctgctgccctcaaaggggcccattcacctggaggggcctgcaaaccattctggctacccacagacatccctatcaccccactcatcttgcttggtgaacccctctgatgctgctcacctcaggtctttctatacccaacgctcaggagaaaagacctgctattgcacatgtgtgtgtgcgtgcctgtgtgaatatttgtgaaaaagaattaaggtgtcaaattattttaatactaccaagctctccccaggaaaaggaagaaaagagacagaacgaacaaacaaaatcagaggactaggacccactgtagcagatgtcctcatgctgctgctctggccaggagagcaccatctccaatcctccttaggatggtcatcctagtggatgttccagggacaagctctcggcactgtaggaacgtacccacagcacagaaaaagtgctttctttggacctggaagattttcccacatgctctaaccaggagagggagggggaagctcctctcactcacttctacattcctatctccctaacgatagctgaaatcccaacaccctggccttgggatgttcatcaatctcaaacgctatctaaataagaccgaatgctcttctgaacagctttgcaagaaatgaggtgaaagaagtttagggaaaaatgttggttcataagttgattacaaaaataagctggaaatttaattctgacatattctgcatgagatgggaggagggcacaaagactgtgacatgagttgcttccacaggtgagctggtagtgccaccagggcagtgtctaccctccagattcaaaaataacagccattagctgggtgcggcagctcatgcctataatcccagcactttgggggacaccaagggaggtggatggcttgagttcaggagttcaagagttcaagagttcaggagttcagcctgagcaacatagcgaaactccgtctctactaaaaatacaaaaattacctgggcatggtggcaggcgcctgtaatcccagctacttgaaaggctaaggtgagaggatcacttgagcccaggaggtccaggctgcaatgagctatgatcacaccacttcactccagcctgggtgacagagtgagaccctgtctcaaaaaagaaatcaattaaaaaaaaaataaggccaggtgtagtggctcacacctgtaatcccagcactttgggacaccgaggcaggccgatcacttgaggtcaggagctggagaccagcctggctaacatggcgaaaccccatctctactaaaaatacaaaaattagttgggcgtggtggtgcacatctataatcccagctatttgggaggctgaggcaggagaatcacttgaacccaggaggcggagggtgcagtgagccgagattgtgccactgcactccagcctgggcgacagagtgagactctatctcaaattaagctaaacgaaacgaaacgaaacgaaacgaaacgaaacgaaactaaactaaactaaagtaaaagctattgcatgtagagggaagattttttaaattggaggaataggactgatacagtttgaatgattgtcccctttaaatctcatgttgaaatgtgaacccccacgctgggaggtgtttgggtcatgggggtggatccctcatgaatggcttggtgccctccctgtgggaatgagtgatttctcactctattagttaacatgagggctggttgtttaaaagagcctggcatctctctagctccctctctcaccatgtgatgcgcctgctccccctttgccttccaccacgattggaagctttctgaaaccctcaacagaaatagatgctgatgccacgcttcttgtacagcttgcagaaccataagccaaataaacctcttttttttttcttttgagacggagtctcgcactgtcgcccaggctgaagtgcagtggctcgaactcagctcactgcaagccccgtctcccaggttcacaccgttctcctgcctcagcctcccgagtagctgggactacagacacctgccaccacacccggctaattttttgcatttttagtagagacggggtttcaccgtgttagccaggatggtctcgatctcctgaccttgtgatccacctgcctcggcctcccaaagtgctgggattacaggcgtgagccactgcgcctggcatctcttttctttataattacccagcctcagatattcctttatagcaatgcaaaacaaactaatacagggaccagagtagtctctatggttctcttttacaggggtctgattacaggattcataaactttcttcattaggaatgatggtaatgtcagaattttatatcataaacatttagtttccaactagcaaaacttcaagtagttgataacaaattcatctcatcatagcaaagtattttattagcctttatttcctatagatattttataatctagcagtatagtaatatttttaagttggcatttgttagtatttaaagcatttttaaagtttttgtcatcactgactgaaggcatgacaaatcaagaaggtaataaaatctctattaaatcactgctctatctactgtgattaatatagcttgatcttaatagtgaaacgtttagaaacagttgatttctcaggtgtgaaagactttaaaattttgctctttctgtaccaaagaacaacagagatttgatcaagtaaatgtgcctataaaggataacttcttttttttaccaagagtatacaatttctatttatgtttaaaatcaaatatgataaccatatccattatacattaagaaagccgtatttaggaaccaactcattattctgaaacctggtaaatgaagggaaagaatgaaacatatattctatctctgctttatgagctgactgttaaagccataaaattgcacctacctctagccaaaaggagtccaataaggccagcaaaaccaataacaccaagtctcggaaaaaatccaggaggtgcattttggagatagtcatagctgtctacaatagaattagaccaggaagcagttccataaatttctcattaaaaaacaaaacaaaagtcttatacagtatataatatgtatatatagtatcaagtgcttttcaaaccacatattctctgcatcctgctactatacttctcttcaacatactctttttatgtgacatataaacaagatttactattcacatagcaagtgtccaattttcttttctttctttttttttttttttgagatgaagttttgctcttgtcgcccaggctggtgtgcaatggcgtgatctcggctcactgcaacctctgcctcccaggttcaagcaattctcctgcctcagcctcccaagtagctgggattacaagcgcccgccaccacgcccagctaacttttgtatttttagtagagatggggtttcaccatgttggccaggctggtctcgaactcctgacctcaggtgatctacccgccttagcctcccaaagtgctgggattacaggtgtgagccactgcgcccggctgcaagtgtccaattttcaagtacctttggtccaacaacctactgacaatgaagtaaatgttaaattactttcatattcctgaaagcaacagatctgaatcagcaatttgcacagggaggaatacaaatacagggatcctttgctattcaaactcttgttatggaaacacaaaaacagaatagatttggataaatctttggatagatctattgctatctgaagctttgctgcttgctctctgaaactcaggaaccaaaaacaagctgtgagtggtggctcattcctataaactcagcactttccaaggctaaggcagaagaatcatttgagcccaggagttcaaggctgcggtgagctaggattgagccactgcactccagcctgacagcctgacagcctgagccacagagcaagacacagcctcttaaaaagaaaaaaaaaaaaaaaaaaaaaaaaaggaaggccaggtgcggtggctcactcctgtaatcccagcactttgggaggccgaggagggcggatcacgaggtcaggagttcgagaccagcctgaccaacatggtaaaaccccatctctactaaaaatacaaaaaaattagctgggcgtggtggcacgctcctgtaatcccagctactcaggaggctgaggcaggagaatcatttgaacccgagaggtggaggttgcagtgagccaagatcgcgccactgcactccagcatgggtgacagagcgagactccttctcaaaaaaaaaaaaaagaaagaaatcaaatacattagactcagaaaaataagcatcctttgccatctgaactcattactcgaacagaagaacagaataaatttggataataaaggaaacttgtaatttcactcagaaaatagccactgttgatcgctgttgatggtgatagaataaaaataaatacaacatgtgacctattcatcatgactgaacatgccttctgacttcattcacataatgcctcgtctcctctccactgagccaatcccacctcataaaagccaagttgagtcctacttccacacaaaagcctttcctaagctcatcagttcacacctctctccctcctctaaagtcccatcatatttattctctgtaccatcacttggtacctaatcctatagtaccctgtgtttaattattcaggtgtatatctggtgtctccccaaggagaatgtaagctccttaatgatagattgcttacacttctgtgttatcttccctcagtggtaataatggatgttcattcaatagatatttattaagaatgatggctgggtgtagtggttcacgcctgtaatcccagcactttgggaggccaaggtgggaggattgcttgagtccaggagttcaagaacagcctgggcaacatggcgaaaccctgtctctacaaaaaattaaaaaaaaaaattagccaggtgtggtgatgcatgtctgtggtcccagctacttgggaggctgaggtgggaggattgcttgagtccaggaagtcaagactgcaatgagctatgatcatgccactacactccagcctaggtgactgaatgagaccctgtctccaaacaaaaacaaaaacaggccaggcgcagtggttcacgcctgtaatcccagcactttgggaggccgatgcaggcagatcacaaggtcaggaattcgagaccagcttgaccaacatggtgaaaccccgtctctactaaaaatacaaaaattagccaggcgtggtggcgtgtgcctgtaatcccagctactcaggaggctgaggcaggagaatcgcttgaacctgggaggcagaggttgcagtgagccgagatcacaccattgcactccagcctgggcaacagagcgagactctgtctcaaaaaacaaaaaaacaaaaaaacaaaaatcacactgccaggagttgataaatactggatgtattccatcctggctaacatggtgaaaccccaactctactaaaaataccaaaaaaaaaaaaaaaattagccaggtgtggtggcaggcgcctgtagtcccagctactcgggaggctgaggcaggagaatggcgtaaacccaggaggcggagcttgtagtgagccgagaccgcgccactgcactccagcctgtgcgacagagcaagactccgtctcaaaaaaaaaaaaaaaaaaatactggatgaattaacaaatgaattttagctaggtcatgacttacacaaagccctcatgtctccttctcaatctcatcttcagcactccctatctacttagggttcctcaaacatccaataccaagtcacacctctaagcctgatcatgctgggcccagtgtgcaatgcctgcttccagcagtcccacccccacattttggagtggctaacactgctccttcaagattcacttcagaagtccttccctgactgctcccacctcctcgatttcaattaaactaatctccttcctctgtaccttcaataatggtctgtgattatctctgtatttgcactagtactgaataatatattacacgcatctcagtggttgtgaccactgtcttaaccaatctcaattttcgaggcctggcagaatggtgacttaaaaaatatatacagaactgaactaataaactggaaaactcagcaattctgtcccctaagtaataccagatacacgccagttttccttttcctgggttctttgggaaatgtgatcattttaaatactactataggacttgtattatgtttgcattaattactgtctggcctgttacttattttgcctttagcctagtttttactttccatcctctagtctgggtcatttgaggcaattttttacttccctttatttttgcctactagcccagtgttgctcaattctagatgtgtacacagagcagttgacagagggacacccagatggctctggtgagctgggccaaagtgggtaaatcacaaagaaaggggaaagaagatatgttttaagactgtacggagtctgggcaaaaaagtgagaccctgcctctacaaaaagtggaaaaaatgtgatggcacatgcctgtaatcctagctactcgggaggctgagctggaaggattgcttgagcccaggaggttgaggctgcagtgagctatgatcacgccactggattccagcctggatgacagagaaagatcctgtctcagaaaaatttaaacaagagacctctcagccacacatggacagataaaagactatatcaggagttctctagtttcctcggataaaaatgaagataataaggtatctgtcagcttgttatgagaatttatatatatatatatatatatataaaatttttgtgggtacatagtaggtgtatatatttacggggtaaatgaggtattttggttcaggcatacaatgcataataatcacatcagggtaaatgaagtatcctttacctcaagcatttatcatttttctttgtgttacaagcatcccaattatactctttcagtttatttacaatacctaaaagagtatagcttttttagttatttaaaatgtacaataagctaggcgcggtggctcacacctgtaatcccagcactttggggggctgaggtgggtggatcgcctgaggtcaggagttctacaccagcctgaccaatatggtgaaacccgtctctactaaaaatacaaaaaataggctgggtgtggtggcgtgtgcctgcagtcctagctactcgggaggctgagacaggagaattgcttgaacctgggaggcagaggttgcagtgagccaagatagcaccactgcactccagcctgggcaacagagtgagaatctgtctcaaaaaaataaaaaataaataaaataataaaaaataaaatgtataataaagtattattgactgcagtcaccctactgtgctatcaaatactaggtcttattcattctaactatatttttgtactcattaaccatcctcactccacccccaataaattggtatttgtaaagcacttagaatagtacctgacatataagtcttaaataagtgtttatgaaattaataaaattaagatgttacttattaacatgccttaataatttaaagaaccagtagggggccaggtacggtggctcacgcctgtaatcccaatattttgggccgaggcgggcagatcacttgaggtcaggagtttgagaccagcccggctaacaaggtgaaaccctgtctctactaaaaatacaaaaactaggtggatgtggtggcacacgcttgtaatcctagctactcgggaagctaaggtgggagaatcgcttgaacctgagagacaaaggtatcagtgagctgagactatgccactgcactctagcctgggtgacagagtgatattttgtctcaaaaaaaaaaaaacaaaaaaccagtaggcagctattgttatgtttgtcttcaaacgataaatttatctgacagtctcagaaatatcaggacatcaatacaccatggtgatcttaccaaagaaactgtacttatgtttattttgttctatcatggaaacaaacccttgtaaaaacaagattttgtttgcgagatgcctaataaggggaatgaaatatgatcggtatctttattaatttaccagtttctgattaagattagtcagaacatggactgtgaatccagtttgtgagtgtatgtgataagtggcccacaactgaaaaataatcaaggaaaataaaaccaaatgaaaaaaaagtaagaacactatcaattatgcagtaagaccttttataggagtaccaactcagctccttcctgcttcaaaacttctagagcatctattaattgcaatgcaaatgagctattccgattcagaaaatctattgatgaattagtatggtgtattacgctgcacctagaaatgagatttcttttttttaaagcagtgtatctgtacttgctagcccaagaatcctaacgatcttgaagagacttacctgactatttggggacactagttgcctgaaatctgatgaaaacaacagctcctcttcccagaaaaatccacatagctctaaaattctgcatataattttaaggaatacacagatttcttggagctcattcatggaactccgattaaagagttcaatgttaatgaagtagctgattatgcctaatttaaaatcaacttacctaacccccattgaaccaaactttgcatcttgggcttagtttgggagtacgtttcctaaaaaggtaaaaagaaactgaatgaaactattcacaggatctgctgattagaaagttaacagaataaatatacttgtttttactgaataaattatcatgttattaacgctttttgaacaaagggatacactgtctgtctgggtctttttgtttgtttttcctattataatcttcccttcactgcaaattactcagcagaatggcttactactgccacaggaagcagattccaaacagagtggtttcaacaatccagccatttcactcttccattaaaatggaaaaaatagactaaaaatcaatccccttgatatttaagtggcaagcttttctccatgagattaaacctgtctttcatattaactacttcctgatctgccattaattagagcctacatctggaaactgcccatttgaagcaagaatgaccagctttaatgagacaaaggctatagcccaaagcaaatgaggtgtcaacattctcttaaaaacaataaaaaggctttgtggccaggcatgatggctcactcctgtaatcccagcactttgggaggccgagtggggcagatcacctgaggtcaggagttggagaccagcctgaccaacatggtgaaaccctgtctctactaaaaatacaaaaattagccgggcgtggtggcacgcgcctgtagtcccagctactcgggaggctgaggcaggagaatcacttcaatccaggaggcggaggttgcagtgagccgagatggcgccactgcactccagcctgggcgtgtctcaaaaaaaaaaaaggctttgtacatgaatatcacatgatcctaaaggaaacgagggacccgctagaaggtacccaccttcaagaagtctacagtgaagacaagaagagatacatgggtatcagaaggtatcaaaactagttgccatttgggaaaggattttttttttatttttatttttattaattaatttttttttttttgagatagagtttcgcttttgtcgcccaggctggagtgcagtggcgcgacctcggctcactgcaacctccgcctcctggattcaagtgattactcctgcctcagcctcccgagtagctgggattacaggtgcccgccaccacgcccaactaatttttgtatttttggtagggacagggtttcgctatgttggccaggctggtctcaaactcctgacctcaggtgatccacctgccttggcctcccaaactgctgggattacaggcgtgagctactgcgcccggcctggaaaaggatttgttttgtgtaattcagttcaagtcagaacaagctatcctcattcttttaaatgacctgaaataataaatgccgaattagccagaagatctaaagaactgagtatcgcttcattaaaatccattatttcacgcctgtaatcccaacactttgggaggctaagacaggagtatctcgtgaggtcaggaatttgagaaccagcttgggcaacacagcagagaccccatctctacaaaaaaataaaaatattaggctgggcacggtggctcacggctgtaatcccagcactttgggaggccaaggcaggtggatcacgaagtcaggagatcgagaccatcctggctaacacagtgaaacctggtctctactagaaatacaaaaaaattagccgggcgtggtggcaggcacctgtagtctcagctactcgggaggctgaggcaggagaatggcgtgaacccagaggcggtgcttgcggtgagccgagatcgcgccactgcactccagcctgggggacagagcgagactccgtctcaaaaaaataaaaaaaataaaaataaaaataaaaatattagttgggcatggtggtatgtgtatgatgtccgagctacttgggaggctgaggtgggcagatctcttgagcccaggagttcgagatcagcccgggcaacatggtgaaaccttgtctctaccaaaaaaaaaaaaaaaaaagaaaaaacttcagatcaatatctagaatgattgccgacttcttttgctagcttaatatttttactattaaaaaaaattaaggccgggcacagtgggtcatgcctgtaatcccagcaccttgggaggccgaggtggacggatcacaaggtcaagagatcaagaccatcctggccaacatggtgaaaccccgtctctactaaaaatacaaaaattatctgggcttggtagcacacgcctgtagtcccagccactcaggaagctgaggcaggagaatcacctgaacccgggaggcggaggttgcagtgagctgagactgcaccactgcactccagcctggcaacagagcgagactccgtctcaaaaaaagaaaaacaaagaacaaaaaaacaaaattaaattggttcttcaagaaaagggctagaaattgctggtctgaaaaaggaaccaggaattagaaatatttctactcataaaggctttgttctacccaggaaaacaaaaccattataattacaaaaactattataattacaagcaagtttttatatttagtagtagtggaaataaacatatagataactaatccatcatccagagaggtattttgctgcactgagtatcacgcatggaagaaaaggtaaaaaacaaaaagcaaccttaggctaaaaggtacaaagtacttttattgccaaaaaaaccaaacaaacaaacaaaaaaaacagacagactacaagtaacagtagtcatgcctacatgatacaaaaatatacacacaaatttgctgactttatcttaactaccagaagtttaaaaatcttctagaacaagagaataaagtctaatcattttacaacatgttatgtttaaagtctttaggtattacttaactcaataatatggttatgatacttaagtataatggcctaattcttattgttgatagagtccatgctttactattttctttctaaattggtgaacaaaagttcaacagcagcataggcaacggaaattaaaaatttttaaacaagctctggatcaaaattgaatttaggccaggcatggtggctcacgcctgtaatcccagcactttgggaggccaaggtggacagatcacttgaggtcaggagttcgacatcagcctggccaacatggcgaaactctgcctctacgataaatacaaaaatgagccaggcatggtagctcgtgcctgtaatcccagctacttgggaggctgaggcgggagaactgcttgaacccgggaggtggaggttgcagtgagctgagagcacgctactgcactccagcctgggcgacagagcaagactccctctcaaaaaaaaaaaaaaacaaaaagactaaatttataaatctcaagcaaggtaaatctagacaatttcccacatatctacatctattagtttttattaatttcaattttcaaaatcaagatcaagtacaacaaacatatgtatcaaagcctacaaaagcattctatagattgtaaacgttggttactgatgttaaaaatcacagaaatacttttcatttacgtaatgacaaatgcctgacctaaaacccaggcagggacagaaaccaatctgtatatgtagttctttggtcactagaacaaatagttcagtaatccagtatggaattctaccctattttagtatagcattcaaaatgccatatcccctcctggtttaagtggcactgatttgtatagtggggggagaaaaacttcgcaatttttatgtaagtgtttacgttgcatctttttcctttgtttagagttccagcccacaagcctcccctggtagacaacaatgttttcataactgcaagcaacaaggtagttcctagcccctctgctctctagttaaggcgttacgcactgcccagggagagggaaattctctctgtagctgtggcaacagctgtcaccaggaagctagggcatctctgcaacccctcctcagatggcactgaagaacatctgtaagtcaggcacttttaacttggggccttgtatttcaacattttttgtgggtacgtagtaggtatatacatttatggggcacatgagatgtgttgacacaggcatgcaatgtgaaataagcacaatatggagaatgcggaatctatccgctcaagcatttatccttagtgttaaaaacaatccaattacactctttaagttattttaaaatgtacaattaaattattgttgactacagtcatcctgttgtgctatcaaataggttttattcattcttgctacttgctattttttttttttgcacccattagccatccccacctttcccccagacccccactacccttcccagcctctgtcaaccatctcagggccctttatcatgcctttttccaaaaacatgcagccaatacagactttcctctatggactctaaacagaaatgcgttcactccattttcagaacagttgtacctgacaccaggttgtgtatggctcgcaatagtgtcggagctgtgagatgctttcttcaagctggctccttgcctcctccacatacttcgattgaccctcaggaactgagtagagtgaaagctgcgcacattaaaacaaaacaaagatttaaaagatgtactgtctacaggatacatttatcaaatttgtaagtatttaatataatatttctagtaattcatgaattacagtgactctgtggtcgggtgtggtggttcacgcttgtaatcccagcactttgagaagccagggcaggcggatcacttaaggtcaggagttcgagaccagcctagccaacatggcgaaacccagtctctactaaaaatacaaaacttagccaggtgtcgcggtaggcgcctgtaatcccagctacttgggaggctgaggcgggagaatctcttgaacctgggaggtggaggtagcagtaagccaagattgtgccagtgcactcaagcctaggcaagagtgagactccatctcaaaaataataataataatacttcatgaattccagtgactctaagggttacaagcaacctgaactttatctcaaactatctctgcaccttatttccataatcaacgaggccaaggccaaaagggcagggctatgaggtgtcctactttctccccacccactgactacaaacaaagcagctcctctttatccattttatatactggtatttggtattccaccttagattgagcttggaaaaaagattttattactctaaagggtgggtgaaggggttaaaaaagcttgagagtaaccaaagggcatgtcattcagttcaaatgattggtctgatgttaatcaaagcaggacagcaggtttattctccacccagagaacttcttacagccactgctggctgccttctttaccctcaaaaatgccactgtgccaaggcctgagaagcgagtaaagggcaaaagataagctaattagctttatgtaaacaccaatctagtaaccctacccaggactgaaggtagatccttacctcactttattcaaaggcaacagaaactgaatatccaaaataattagtgggaagtacagaccaaaaaggaatgtaaacagtagagagaagatttcttgttttttttttttttaaatttagtatttattaagtacatacttatgagcggctcctctagccaagaaacagaaaggatccagatctctaatttcttagagaggaaaaaatgtgaatatattcttggctcgataagaatcaagataagccaagaatcaggcagaccacttagaaaagtgagttgtgcttataacctgttgggacacagtggattccccagtaaacatttataaagtattccttaattgtgcccttacctaagtatcattaaagtttatctgttgaaaaagccatagtttaatatttcccacaaattaaacaaactataaggaaatatattttctctgtttaaatgtcttctggctgggcgtggtggctcacgcttgtaatcccagcactttgggaggccgaggcaggtggatcacctgaggtcgggagttcgagactagcctggccaacatggtgaaaccttgtctctactaaaaatacaaaattagccaggcgtggtggcacatgcctataatcccagctacttgggaggctgaggcaggagaatggcttgaaccaggaggaggaggttgcaatgagccgagatcgcaccattgcactccagcctgggcaacaagagcgaaactccgtctcaaaataaataaataaataaataaataaataaataaataaatgtattttaaacagtcacatcttcctgatatacaatttgtaaaaaattatcctacagtaactaaatcagacactcaaaatatatcgcaacatgaacaacatgttacctcatcaaccttcacggaatttttgggaggtgagtccttttttggtgctgcatagactttgaaggtgagcaagctcaggctggctggccccacggacctctgaattacctgaaatgcagaagcaatcttaaacctctctatgttacagaccgaatgtgcagaacatgagcatattcataacctcagccactccccaccctgaaaggcttactgtgctttattttatttttatttatttttatgttttcaagatggagtcttgctctgttacccaggctgcggtgtagtggcgtgatctcagctcactgcaacctccaacgcccaggttcaagcgattcttctacctcagcctcccaagtagctgggattacaggcgtctgccaccacacccggctaatttttgtatttttagtagagatggggatttgccatgttggccaggctggtctcgaactcccgacttcaggtaattcgcccgcctcggcctcccaaagtgctgagattacaggtgtgagccagtgcacctggcctacaaaatatatttttttaaaaaatcagccaggcatggtggtgtgtgcctgtagtcccagctactcaggagactgaggtgggagaactcttgagtttgaggcttcagtgagccatgatcatgccactacactccagcctgggcaatagagtgagactctgtttcacacacacaaaataatcgctccactaaaaaaaaaaaaaaaaaaaaaaaaaaaaaaagatgggctgagaggaggagagttatggtttattaatttaattgtgaatataaaaaatgtgctggacgcagtggctcacgcctgtaatcccagcactttggaaggcagaggcgggtgggtggatcaccaggtcaggcattcgagaccagcctggccaacatagtgaaatcccgtctctactaaaattacaaaaaaaaaaaaaaaattagctgggcgtggtggcgggcacctgtaatcccagctacacagaaggctgaagcaggagaatcacctgcacctgggaggtggaggttgcagtgaaccaagattgtgccaccgcactccagcctgggtgacagtgcgagactccacctcaaaaaaaaaaaaaaaaaaaaaaaaaaaaattcagacccctcctgcgaaggccgtggcagttttctaggagggacgttgatctccttaggttgtatcctggtgctgctggttctgcctaataattgtgatgggcacaaaccacatgaactaatgtcagcactagctggctaatctgtatcgtggaagcaaaagaaatctgtagcaaaactgcattgaaattaagacctcaagatgcacacttaatacttcaagatgtatcaattgtttttaaaccagttaaagtaacaaccacccttttttttcttaatggctttcagctctttatttgcttctgaaatatgggaatttgcagccatacgtttcaacagatatttttgttatattttagctggcattacgttttgtattacagaatagcctcatctttcacattacaggcactgcaaatctcagtaatatgatttccaagatgctaaatcatgcctaaatagttagagagaaatcaatcactcatttattttccacctctcctccatccatttccttttgtctcatttgagcaggaaataaacaattattgagcatgccttgtgtgttaggcacagccatagaaataggaatatggagtaagacatatcctcaccctgaaagggcttccattctggtaggaagaacttgatagatgtaaataaatggacaaacttttttttttttttttacacagggtctcacactgttgcctaggttggagtgcagcagcaggatttctgctgcactgcaaccttcccatcccaggttcaagcactcctcctgtcttgtctcccaaatagctgggactacaggcatgcaccaccatgtccagctcatttttgtaatttttgtagagacagggttttgccatgttgcccaggctggtctcaaactcctggattcaaacgatccacccaccgcggcctcccaaagtgctgggattataggtgtgaaccactgcacttggcctgggacagattaaaaaataaaataagggaggctgaggcacaagaatcgcttgaacccaggaggtggagattgcagtgagccaagatactgccactgcactccagcctgggcaacagagcgagaccctgtctcaaaaagtaaataaataaaagaaaagtgatacgggaggggcaggcagggaaatgctgggtagagaagggcgtggtccctggctagggctccacccctgggcctgtgcccaccaacctaggtgaggacaggcatttctgtttttgtgcccaaatatcgtatttcccaagaccaccctggcccaccacactcccatcttgtgcctataaaaaccccgagaccctagcgggcaggcacacaagcggctggacgtcaagagaagcagaggcaaggaacaacataccagcagaagaacacagtgacagactccggcaggccaccaacagcagaacggcaggacaacgcggagtttggctgagggcggtcagaggagagcctggctgctaagcggcctgactccaggggaaaaccaccttcccactccataccccttctggctccgtttccatctgctgagtgctacttccaccattcaataaaaccttgcactcatcctccaagcccacgtgtgatccggtttttctggtatactcaggcaagaaccctaggatacagaaagccctctgtccttgcaataaggcagagggtctaactgagctgatgaacacaagctgcctactgacagcaaaactaaaagagcacacgtaacacacgcccactggggctgcagaagctgtaaacatccacccctagacgctgccatggggttggagcccacactccccacgacctgcccatctgcctgctttccctaggggttttgagcagtggggcacctaagaagtgggccacactcccatcacatgccctgtaagagggacaagggaaattccccttgtttcaaaagcatgaattctcccggctcttaggcagttctacagaaagacaaaacaagtataggacattatagacagaggaatcagcatgtgtgaagccacgaagctgggaaacagcatgggagaagtgtagggagttcgagttttgtgggagggagcagagtgacagagagatgagtcagagaagttggttgtagccagatcataatgggactcgtgtggctcacataaaagtcctaggtaataaataccaaaagatctcaaataaggatggaatatagaatcgagtttgccatttagaaagacgattatttctcagtgtggcgctttaagtcattaaagggccagctgaccagttatggtgctgctaaaacaatgaaggaaagaaataagggcccaaggaaagattgcacaggagaggagaaagaggagaaagtagaattgagatagtttaataggcaaaattagcaggacttagtgaccaaagggaaaggaagagtgacgatgaccttggtttaatttttattttcatttattttaatttttaaactgacaagaatcgtgtatatttattgtgtacaacatgctgttttgaaatatgtgtacattgtggaatggctaaattgagctaattaacatatgcactacctcacaaattaatttttgtggaatctaaaaaggttgaactaatggaagtagagagcacaatggtggctaccagggcaagggctggggggagttggggagatattggtcaaaagtacaaagtttcagttaggaggagtagttcaagagatctgttgtacaacataatgactagagttaacaacaatgtattggattttcgaaaatcaggaaaagagtagattttaagtgaccttggggtttccgatgggtttttctagttgggtggtgacacagcattcctgagagaggaagtagaaaaagaggggcaagtctgagggaaaaatgatgagttggttttggacatgttccagagaccgacagacagctagaggtctagtcatctatctatgtatcttttattttacttgaaaagctaaagtaggcaaacttagaaactgttgtcttttggaaattaagaaaaagttgacctgaaattttaagtccataagaacatgttttttgggtctggacttcctcagcacttcaggggtgtatttatttctcataaagcacagtaaggccgggtgcggtggctcacgtctgtaatcccagcactttgggaggccgaggtgggtggatcacctgaggtcgggagttcgacaccagcctggccaacatgatgaaatccagtctctacaaaaaacacaaaaattagccaggcgtggtggcagacgcctgtaatcccagctactcgggaggctgaggcaggagaattgcttgaaactgggaggcaggggttgcagtgagccgagatcgtgccactgcactccagcctcggcaaatatatatattatatatatatataaatatataactatatctatacataactatatatatatagcagagacagggtctcatcatgttactcaagctggtctcgaactcctgagctcaagcaatcctcccgccttggcctcccaaagtgctgggattacaggtgtgagccaacacactcagcctatctttgattttaaatctcaactcatttcctttaacattttattggattcttaattattaatttctactttaccttcccctcttatcttacttgtttttctagttttaatattattctaggcctgcctccctttactgcctaaactgttttcttcttcttcctcttctcctattagttttcctccctaagcctaccctgatacccattccacagcaagaactgtggccacaagggtggtagcaccaaagaaagctggctcctgcagcggccttttcagcttccagcaggctctcaacagacaagcaaacaaaacaaagaaaaagcaaacctcaccccaggagacctgggagacctacaaatgaacactccccaggaccataattcttagtttgcagagaacacatgatttactcgaggatttctcaaactcagcactactgacatttgggttgggtccttctttgtggggctgtcctgtgcactgcaggaagtttggcagcatccctagcctctacccactagatgccagtagcacctcctcccagtcacgacagtcaaaaacatctccagacactgccaaatgtctcctggggagcaactctcccactgagaacctctgatttacttgagtaagtattactttctgacatctctcaccatctagacttgaagaaaatctgtatgttttaaaacccatggcctcaaacatagtgagaaaccagaacaatcactactaggccggggaggtgggagttggaaggaagtggacttactgagaagtggcacaagtgaactttctggggtgaaacaatcttgattggggtatgggttattcaaggtatatacatttgtcaaagctcaaattgtacaactaagactgtacaacttaaaaatctatgtatttcactctatgtaaattagactttttaaaaaatccatcagctctagcacacctaatccatgccaagctcattcctaaggagccagccacacacctgaccatggtaaggaactggtatagatctgtgtgatggaaacccatgggaggagccttggtaaaaggtccccaggtagacatggctgaagctgatgcactcaacatcttggctgattcatcttcctttttagcttcaaagggggctcctcctggtgcgagatgaccccaccctgcctcagcatgctcaccacctttccctcttaacagtaaaaaggaagctggccagaccagatgtcatcacaaatggccatcttcgacactgtgtgcctgccaggtggttatcataatttgttagggctcatattgagtattcaggccaacctattcaaaatcaggatttaagaagggaaaggctaagatgggtagaatcaccccaggacagtgtaagggcacaaagaggagatgaaccttcttcaatcttttgtctccccaaggaagaacaatccagttctttgaagaaacacaatcaactttcagggtctgggacataataaaaaaaaatctctagccttatcaactttcctcctgttcgcactctggatgggttgctttgtgagacatgaacacaaaggtattctctctccatgaggagtcctgacccattatgatataatcggactgaatatacctcccaagaagtgaaatctcccccatactttttctttttccctttttttttttttttttttttttgcgacagagtctccctctgtcgccaggctggagtgcagtggcatgatcttggctcactgcaacctccgcctcctgggttcaagccattctcctgcctcagcctcccaagtagctgggactacaggtgtgcgccaccacatgcggctaatttttgtatttttagcagagacggggtttcaccatgttggccaggatggtcttgatctcttcaccttgtgatccgtccgcctcggcctcctaaagtgctgggattacaggcatgagccactgtgcccggcctcccccaaactttttctgatgcagggctgtaatctctagactgcatgtacccacgccctgagcactccctttcccaagtgatagtccttgagaagccttgttgccaggtacactccctggtcagggcagatgagttggctcagaaaatgagtacatatgcacctgccaagaactgattagatatggtctactttgcattatatgagttaggcttgctcaatcaaagtcaagcaagctctgttaagagctgaatctccaattagtgctaagttacaggctagatcaaaggtggcatttctttagatccagcccctcgggagtatacccttcagttactaaatgcctttcttggcattcagctagttgggggtctcaaagtaaggactctaatgtgttggcttctctgaggttttgaatacagctgtaagacccatagtcacagagaaaacgaaaatttggcttaaaggtaaactggtggcccttagctttgcaaacctcagagggagtgtcattgagttttctcactcttgtggctaactcttctttctttctggtctgatcctactccccagcaaagtatcaaggtacactctatcttggaccttagactctctatgtctcaaaacttttgtttcgcacagcccgcaaggggcttgtcaatggaaacagagcaaccagtattggtgttgggttagatgaggccctaacaagaagtgtaaaggggtaggctgtcatcatcttaaagacatttggttcttactctgtctccactgaagcttgcgaaggactgatgttggcaaaacaaatctggtcaggcaagcaaggttatatataacaattagaagaggtcaaccagggttttatttcaaaaacaaatatttactgcacacccacatcatgtcagacatggtactaaacagataaaacacataagcagacaaggtccctgctcttatagagcttccaggaagcttatgaatttaatcaaagactcaggccacaatttaaaaaataaattaacattcaaaaaaagattcagggcccagcacagtggctcacgcctataatcccaccactttgggaggccgaggcaggtggatcacaaggtcaggagttcaagaccagcctggccaacacactgaaactccatctctactaaaatacaaaaattagccaggcatggtggcatgtgcctgtagtcccagctactcgggaggctgaggcaagagaatcgtttgaacctggaaggtggaggttgcagtgagccaaaattatacctctgcactccagcttgggcaacagagtgagatttcatctcaaaaaaaaaaaaaaaaaaaaaagattcaggcataagattgagtttattaggaggctgaagtgggaggatcacttgaggccagaagtttaagaccagcctgggcaacataacaagactccatctctacaaaaaaaaaaaaaaaaattagccaggtgtttggggcatgcctatggtctcagctacttgggaggctgaggtgggaggattacttgagcccaggaggtcaaggatgcagtgagctataatcgcgtcactgcattccagcctgagtgactgagcaagactctgcctcaaaaaataaaataaaataaaaagattgagtttatcagtcagctccctcagctttaaaggtagattcttagacacagtttaccaagacatgaatctggtaaggtcgtaaacaaacaaatcataatgggtgtccagaaggctaaactgttcttgctttgcaaataaaagtacactgactgcccagaattccatagctctgggatcatgttgtgattatgttccagtaaaactgccttaaagacaaataaaaaccttaagctaaataagtcaccctcagaattattcagactctcatgaatggtggggctcaaatacctaacaacttgctttctttttcaactttatagagaatctagtgaatactctctcccatttaaaaaaagggtgactcttttctcccacaattacagaactattatcttattagacttccatttataatatatgccagcttcatgatagaaggcttttgcaggcctgtgtacacaagaggtttcagaatcacctggggagttgttttttttttttttttttttttttaagacagagcctcgctctgtcgcccaggctggagtgcagtggtgcgatcttggctcactgcaagctccgcctcctgggttcatgccattctcctgcctcagcctcctggtagctgggactacaggcaccagccaccacgcctggctaattttttgtatttttagtagagacggggtttcactgtgttagccaggatggtctcaatcttctgacctcgtgatccgcccacctcggcctcccaaagtgctgggattacaggcgtcagccaccgcgcctggcccacctggggaattttttaaaagcatagattctaacagcttcccccagagtgtctgactctgaatctaagaggggcccaagaatctattcccaagataagcaaagttttgaaaaccaccattccacaaacatatgcttagagaacagttattcaacttaagtttgtataagcactcaaacatacttttaaaaacatttgaaagtataaaatgaaaactgtcctaaatataaaaagaaacagagtgactggccacccactagagaaattatgacatttatttacattcaagaaaatctctcccgtcttaaacaaaacacaacaaataccctccacccctaattccctctctaacaactaccttacccttctaccaacttccattgacaaatttattttaaaagtagactatggttagaaggcagaatagtggatacccttagcaagctgggtagtgactagaagggccacgagaagagcttctagagtgctagtatgtttagtttgtaaaaattcacttatgccccgtttactttcctatatgtatgttatacaaatggtctcagacttacaaatggttcaaccttacatggtgcagaagcgatacgcattctgtagaaaccgcactttgagtacccatataaccattctgcttttcactttcagtgcagtattcaataatgtacatgaaacattcaatagtttattataaaataggctttgtgttagatgattctgcccaactgtgggctactggaagtgttctgagtacatttaagggagggtaggctaaattatgatgtttggtaggttaggtgtgttaatttttgacttaatgatattttcaacttatgataggtttatcagaatgcaaccccaccacaagctgaggagcatccgcatttaagcacaaagtcaaaaaggcagattctgtttgctttctcaattttatctcctcctccctttactactaaatgcacctaaaacctttcttcccaagaccaccaatagcctcccagttgctaaaccccactggacatctggcatcttggttgcaccctgaaactggtgactactctacatcttcaacccctttctttggcttacaggattctaccctatccccattctagaggctttctaggtactctctcctccccttttgggccttctcttcctctgcatagctcttcaaggttgatgagtcatggagtagtctttaactctctcctcttctcactccagggcaatttcattaaaatctaattctttcttttttttttctttcagacagagtctcgctctgtcacccagactggagtccagtggcctgatctcggctcactacaatctccgcctcccgggttcaagggattctcatgctttagcctcccaagtagctgggattacaggcgcccgccaccacgctcagctaatttttgtgtttttagtagagacagggtttcgccatgttggccaggctggtctcaaactcctgggctcaagggatccacctgcctcagcctcccaaagtgctgggattataggcgtgagccaccacacctggccaaaatctaagtctttaactcccactcatatgctactgatgctcaaatcagtatccctagcctgggcctctccctaagcctcaggcttgtgtgtttcctgtgtttctaactccctgagggacatgttaccaggcttttcaactgctacttcaaacaggctatatccaaaggtgaccttttttttggagtgatggaatatattatttctattttccatgtaaataatttaaactctctctatgtaagtatatatacacttacagtatcttacccttctaccaagtttatatatatgtatataaactatatgtatatatatacttatagacttatacatactatatatacttaaaaatatagtttatatagtttaagtatatataatactttatgtatttctatatatagtttacatttatatatttaaaatgtatgacattatgctttcaactatctttctccaaaactgtttttatgagattctctaccttatttaatgatcctacaagccacacaaaggacaacataaaagcaactctttaatgataaagaatgaaaataaatttttttttttttgagacagagttttgctctttcacccaggctggagtgaagtggcgcaatctcggctcaagacaacctccgtgcccctggggttcaaacgattctcctgcctcagcctctcaagtagctgggattacaggcagccaccaccacacccagctaattattttttttttttttgagacggagtctcgcactgtcgcccagcctggagtgcagtggcgcgatctccactcactgcaacctccgccgtctctcggattcaagcgattctcctgcctcagcctcccaagtagctggcattacaggcgcccgctaccatgcccagctactttttggaattttagtagagacagggtttcaccatgttggctaggctggtggtctcaaactccttacctcaggtgatccacctgccttggcctctcatactgctggaattggccaaggtgggcagttcacgaggtcaggaaatcgagaccatcctagaaacacagtgaaaccccatctctactaaaaatacaaaaaattagcagggcatggtggcgggcgcctgtagtcccagctactcaggaggcagaggcaggagaatggcgtgaacctgggaggtggagcttgcagtgagccaagatcgcgccactgcactccaacctgggcgacagagcgggactccgtcacaaaaaaaaaaaaaaagtgctgggattacaagcgtgagccaccgcgcctggcctcagtcaaccttttctgcaataatttccattctgacagcatttttcactcgaaacaaaactattttaatctgattctaattatttaggaggtaaaaatctgaaatgggttttttacaaaaaaaaaaaacaaactatgaacactgacaatacttttgagattattcttattctaagtaaccaacacaaaaaaaagaactatgtgaaagaactcagaatacaacaaaatgatgaagacaataaaaaaattttgtcaaaatcaggctacactgttgtcctcagtaacgtgttgtaaattgaatgaaaaatcaagagaaaggccgggcgcggtggctcacgcctgtaatcccagcactttgggaggccgaagcgggcagatcacgaggtcaggagatcgagaccatcttggctaacatggtgaaaccccatctctactaaaaatacaaaaaaaaaaaaaacaaaacattagccaggcgtggtggtgggaacctgtagtcccagatactcaggaggctgaggcaggagaaaacctgggaggcggagcttgcagtgagccgacatcacgccactgcactccagtctgggcgacagggcaaggctccgtctgaaaaataaataaataaataaataaaaataaaaatcaagagaaatgagtccacaattcttgaaacgtcaaaagaatacagaatactctcctccataaggagcattcaggacagtatctacattttatacagcaatcttttatttttatattttttattttttgagacagagtttcactcttgccacccaggctggagtgcagtgccacaatctcggctcactgcaatctccgtctcctgggttcaagtgattctccagcctcagcctcctgagtagctggaataataggtgcctgccaccacgcccagctaattttttttgtattttcagtagagatggggtttctccatgttggccaggctggtctcgaactcctgatctcaggtgatctgcctgcctcggccttccaaagtgctgggattataggcatgagccaccatgcccggccagcaatcctttctaacatgtagggccacacaccaaacagaacagaggctttctctggaaagggggctggggggaggtggacaatagcaacctgaccaactgtactattttgactttttacaaggaaaagtatttcagtattacttacaacattttttttaaatagatgttttcttttcaaagcagttaccttgataaatcatatatggagtcggaatttactacaactatttatataaatttcataagtgaaatttattttttaaaatttattttattattattattttttgagacagagtctcgccctgtcacccaggctggagtgcagtggtgtgatctcggctcactggaacctccgcctcccgggtttaagcgattctcctacctcagcctcccaagtagctgggattacaggcccacaccaccacgcctggctaatttttgtatttttagtagagacggggttttgccacgttggccaggctggtctcaaactcctgacctcaggcctcccaaagtgctgggattacagacatgagccaccacacccaaccaaaatttacttttaatatgtaatcatatggcttccatttctaaatgccttcagatcacattttaagcctaaaagaaaatcagtctcggccaggcgccgtggctcacgcctgtaatccagcactttggaaagccaagttggttagatcacctgaggtcaggagttcaagagcagcctggctaacatggtgaaactctgtttctactaaaaatagaaaaaattagccaggcatggtggagtgcgcctgtaatcccagctactcaggaagctgaggcaagagaattgcttgaaccctggaggcggaggttgcagtgagccgagatcatgccactgcactccagcttaggcaacaagagtgaaactccgcttaaaaaaaaaaagtaaagaaaatcagtctcgatatattttaaataagagtggtaaagaatagagaatgggccggattcggtggctcgagcctgtaatcccagcactttgggaggccgaggcgggcagatcacttgaggtcaggggttcgagacaagcctggccaacatagtgtgaaaccctgtctctactaaaaatacaataattagctggtgggcacctgtagccccagctactcaggaggctgaggcaggagaatcgctcgaacccaggaggcaaaaggctgcagtgggccgagatcgcaccactgcattccagcctgggtgacagagtgagactccgcctcaaaaaaaaaaaaagattcattatctccacacacacacacacaaagatgagaaaatggcatctgtacgcctatgtttattgcagcactatttacaatagcaaagacttggaagcaacccaaatgcccatcagtgatagactggataaagaaaatgtggcacatatacaccatggaatgctatgcagccataaaatagaatgagttctttatagggacatggatgaagctagaaaccatcattctcagcaaactaacacaggaatagaaaaccaaacatcacatgttctcactcataagtgggattgaacaatgataacacatggaagggaacatcacacactggggcctatcaggggatggagggcaaggggagggagaccattaggacaaacacctaatgcatgcggggcttaaaacctagatgacaggttgataggtgcagcaaaccaacatggcatgtgtacctatgtaacaaaccttcatgttccgcacatgtatcccaggacttagagtaaaatagaaaaaaaaattacaatattagtcttcattaaaacaatctctactggaaccttttctacatctcctaattaaacgtagtgtccaacataaacttttctttctgttgtggtggtggtggcggtaaagaatcaagctttatgtaaacttggtcaataataagattatctcattctactaaaaaaaaaagaagaagaagaaaagaaaatggcattttttttaaaaaaaaaaaagaggaaggggacttgtagtatgattccaccgagttttttgaaaatgtcataccaagggtatatttgaatatgtccagaacggagtctaaaaagatgttagggccgggcgcagtggctcatgcctgtaatcccagcactttgggaggctgaggtgggcagaccacgaggtcagtggttcgagaccagcatgaccaacacggtgaaaccctgtctctactaaaaacacaaaaattagccggacgtggtggtgcacgcctgtaatcccagctactcaggaggctgaggcaggagaattgcttgaacccgggagatggaggttgcggtgaacgaagatggcgccactgcactccagcctgggcaacagagtaagactccgtctcaaaaaaaaaaaatatgatgttaacagtggttgtctataggtggtgatattaaaggtaattcttatctctatttcctgaagtttttacaaaaaaaccattgatttgttttgtaacatgcaaagaacaaaaatggctagctcctgaggatattataaaggtttgccacaaagtttgaagataattccaaatgaggaagagtaaaaatgttttgatcagtgatagaatttttggaataaatataatgacagtataattaaatctatcctctcaaaacgactgttttgatgcattcatttgaatgtaaaatttgggagcactcatactttaacaataacaataaaacccacaatcatttcgatctgtttcacagcaaaggaggatataaagccaagaatttatctccctttgtcactcaggctggagtgcagtggtacaatcatagctcactgtggccttgaactcctgggctcacctaatccttctgcttcagcctcccaagtacctaggactatgggtgtgacggagcacactcagctatttttttttttttttttggtagagatggagtctcactatgtttcccaggctggtctcaaactcctggtctcaagcaatcctcctgccttggcctcccaaagcgctgggattacaggtgtgaaccaccatgcccagtaaagtttagacttcaaacaacattaaaaaaactcttcctaatacaacaaacatagaactattttatgagaaatttttaattctttagttctgtactacagtaattggtatttcctagctctttctcatccactgtaaacagactacaatctaaagagataagcagagaaaaaaatgaggctgttttcaagactaatattatctttttctcacagaaaaccaagttctgtttcatctttggagggtagaattcaccacaaaattaggtcagcaaagcaaacaaaatgtctcatctgcaattgtttcattttctactctttaaagatagcgattagattttataaaattcatgtagaaaaataataaacttgtgcgataaacaggaagaaaaccttagggccaaagagtgagataattgttcatttaggcaggttttgagtcatccagttgggctatactggttttaaagacttggaacacagataatatgtaatttatcaagtccagaatttattttgaacttcctcatccagacagaaatttactgctacttaagactcctatatatatgtgtttttttctctattagaatggcatcctgggacccactcaatcttttctgaattaaggaaatatagggaggaaaaaatcgttgggaaacatttacttcaagtttagcttttcaaatgcatctgtgtttccaagcaactaataaaatgtacatcatttaataggagagctagtctgtcaaagtaaaatctatctgggcagggcatgctggctcatgcctgtaatcccagcactttgggaggccgaggtgggcggatcctttgagcccaggagttcaagaccagcctgggcaacaggctaaaggtgaaaccccctctctacaaaaaatacaaaaaattatctgggaatggtggcacgtgcccatagtcccagctacccaggagggtgaggcaggaggatcgcttgagcctgggaggtggaggttgcagtgagctaagattgtgccactgcactccagcctgggagacagagcatgattctgtctcaaaaaaaaaaaaaaaaatctatctagacacaggtttctatctagacacatggctctgtctcaaaaaaaaaaaatctacctagacatgggtttcatatctctttttttgttgttgttttttttgacatagggtctcattctgtcactcaggctggaatgcagtggcacaatcacagctcaatgcagcctcaacctcctgggctcaagtgatcctcccatctcagcctctcaagtagctgggactacaggcaggcaccaccatacctggctaatttttgcattttttgtagagacgggcggggtttcgccatgttgcccaggttggtctcaaactcctggactcaaggaattctcctgcctcagcctcccaaagtgctgggattacaggtgtgagccaccacgtcgggcctagacccgggtttcatatcttaacagaccaccatgtgcacagagaactctaaactcactaatgaaaactgcctttgacttcatctcagttattcatgtgcgtttttcttctttaaggaaaactgtaagccttttttggaaaaaaaaaatcatgtacaagactcaattcggttgataaccatctgacctcataatgaaaatctgtgcaaaaataaggaacaaaaacaagtaaagtaaatgtttggactatacccagcaactttaacaggactcccaaatggtgtgactccacaaacaggctcagttctatctgccaagtgaggtaaaccatcaacagacaatgtaggaaacttcttggagcccgtataatcactttttgcttacttactcactcaccagtctaacccatgtcacatgaatcagcatctctaataggagaggagactcattttcagcaagcacaaacaaaaacaggctagttcacaaggactgaagtttgtggaatgggggaaaagaaaaaaagaacctttattagttagtttcatatattccattttaaaagactgttcagaagaaggaatagacttcttttcaggaatatctgaaaaaagaaactactgggaattcctccacactaaggcaatgaacatgcacttgtggatctatctctagctcccacagagggggctcctcatcctcatggaaccaaacaaagaagtccttaagcgggagccagtgtgggctttgaataaaacacgctgcattgcttcaaacagccagaaataggaagacaaaggataactgcacttaaagtgcctttaaaacaatattcacttaaaattcaactatactatccataatgcataaagctgtatcaggaaaatatagcttaacaatcaaagtcataggctttcagcatactgaaaactctacgacccttgccctacattcctgcttctccaagttttagtgaacactgaaaataagtttaaaaacctaccacattaagaaattggcactgattaaattttctaacaaaactggcatgaggctatgcaaaaattaggaaaaactcagcaaaagtgaaaaataaataacttccaaattctaaaatataactttagactaggatttttttgtccctgaaaatatataaagtttcatgctgtatgaactaactgtaaaattccacttaagcattattggggaaaatcaactgatacactctttcaattcctttattttaaagatctcttagtactttcttgtcatattaaaaataagtctaaactttttgaaacagatatctttgctattgagatttattacacacctaataacatgcatttatatatctaattttaaatgtacaatacaaacaaatatgcaagttcgtttcctagcctctaagaagttccagtctagcctagaaaggacatgggtgtggaacacatatacatatagattataaattaaacctttacgtcataaaagtctacaaatatcaacaggcctcatggggtaatcaattcatttatcataaatgtctggtacatcatctacttttctcctccactgtgcctctaatctctccgttcttttaatgtatcgttttacttcttctttctcctcttccagtgttagttacaactgtgaggctatctgcatttcagaagtagatagaagaatgctacagtgtcctgagcagaattcatttccaaatgagaagtgaaataacccaagttaattcacgttttacagttgttaagtccagagtgctaacctgcaagcatagattacttcagtggacaaatgtgatacaagaggaacagaaaacaccttacattgatatagtgctttgtagttcacggttcttttcgcatattatctcaattgaatctcccaacaatcctgtgagatacagagggacatactactatccccacaggatcatgatcagaggacgctgagagattaagaaatctcaactggcccggcatggtgactcatgcctgtaatcccagcactttgggaggccaaggagggcagatcacttaaggtcaggagctcaagaccagtctggccaacatggtgaaaccccatctctaataaaaatacaaaaactaggccaggcgtgctggtgcatgcctgtagtcccagctacttgggaggctaagggaggagaccggcttgaacccaggaggcggagggtgcggagagccaagactgcgccagtgcactccagcctgggtgacagggcaagactccggctcaaaaaaaaaaaaaaaaaaaaagaaatctcaacaaggtcgctcagccagaaacacaactagaacctgaggctgaaaagattgcatccagagctacagagcagttttttcttcgtctctgtgatccactgtctaacttcttcgaaaggtaagaaaggaaaaagaaacaaccaattgattctgcacataaaaaatgtatttatgtgagtaaaaatgtagttactataattcctcaagaagaattcccttgaagatgcttaaactgttagggaaaaaaaaccttcattatctttccaaatatgtggcttttaaaataatgctcaagtataaaagttacattactcttccaatttacagatgattttccttttccatttagcattgtaattctccgcgcagttctagtaacatactagtaacatggtaagaaaattaatttcaggaagacaggcaatgtaagtattacactaagccacaaagaatgtgtgaggtaataacacctcatagtcatggacatgttcactcaggctccttggtgtggtgagctctgagtacaggtcatgttatttgcccttgaggaaggaagtgacacagaccagttttcactaggccaccttcttgccctggaggcttcagttagcagctgatgatttcccaatttccagcccacgtctgtggcaggaaaagtccataccctggggttctacatcaactgatttcccccttccaatgcccagatatttcagcaagcccaacctgttcaaaaccaaaccatcacctccccctcaaaccaaattcaaccttcttccactttcccacctcaatgaatagttcccacctcaatgaatagatcccacagtcaaaagtcaaaagcctgggcagaaaccttaatttatccttctccctcatctaccacatccaactgactaccaagttttgaaataaaaaatacttttggagagccccaagaccgtgcaccaccgtaacacaggtagttacaagatgccatcttacaagatgccaactaaaagtaacagctcacatttcttcagcccttactttgggccaagcactgttctaagctttgcgtaggaatgaatttaatccacacaataatttgaggttggtaagcatctcatccttgttttacaaatgaggaagcagctacagaaaactttagtatctctcacaaggaacacagtgaagcccaaggtcttaacactgttctgaacactctcacacttctgtgtccttgcatgtgcttttcttctctgtttggaaggccctttcaaccttgtctgcctagctccaaagatcagcataggcatgttcttctctataaagccttctgatgccccctgctgttgctcttccctctaagtcagtagatctcaaggctggctgcttgctccaaaaactagatgcctaatcctacccctagagattcttgatgtcattggtataggttctagactgggcatcgggacttttaaaagctccccaggtggctctaacatgcagtcaaggttgagacccactgcatcgttaacggacctttaatgtctgtgctggtaagtgcattgtgagcttctgaaatgaaagtttcataatcaccttggggggctttttcaaaactagcagttcctggacgccaactaaaaagtcagtcagaaccatgcgcaggggcttggaaactgtctccttgaataattctgatttgtggccagatttgggacctctctcctagataagaactgggtcttttcacttgtacccaccagggtccagcatgatgcccagcccatagttggactaggataaaatctgtgtaatgaaggaaatctaataacgtgaatctgggtatatgtatccaatattcaaacttcctgcagcagcacaaggaaaagctgcttcctacaatggaatgcaaatactgggcagcttttcaaatgtgttttttaatccaccaatgccccctagtgacctgaagatgaataactatatcaaaacatcgcagtatatattttaagtacaatgtgtacttaatatgcacataactagtcagacacactgcacttttactaccattgtacttttactaccaacacctatactattaactcctttgccctccagttctagttaacccaagctgttaactcccaaaccccgatcaatcctaccgtttactccatccccactctgcacaaacatacaggagtgctctcagcagagccctcaaagggtctggcctatctttttgttccttggtcagtgcctctcccaaatcccaccatgttcataagaccatccatctcgaaaacacaagaaccattcatctaccgattggcttcaattcttgctagtcaaaggggaccaacgaaaactatagaactagttaaaaaatggagaatctggccgggtgcggcggctcacgtctgtaatcccagcactttgggaggctgaggcgggtggatcacaaggtcaggagtttgagaccagcctggccagcatggtgaagccccgtctctactaaagatacaaaaaattagctgggcatggtggcgcgcacctgtcaatcccagctactcaggaggctgaggcagaggaattgcttgagcccgggaggcggaggttgcagtgagcagaaactgcgccactgtactcaagcctgcgtgatagagcgagactccatctagaaaaaaaaaaaaaaatggagcatttgaggccgcatcccagacctactgaattggaatccattttaacaagagtcacatgcccattaaagtttgacaagcactggttctcaactactagacctaacatcaccattttatgacaaatattttctgacactcttctggtatcctgaaataaaattcatcactaagttacatgcataagtccaaaaagtaaatcagtatactctgatggtagcataaaggtgaataaaaaggaaagatttatgtgaattatatttcagtatgtaaatgttcaacacaactaaagacataaagaacaaccccattttcagttataatttttgcaaagttaaaaacgaaaaaagaaaaaaagaacaaccccacaagtttccaaaacataccattctgttgagtcgtaccattctatggagaaccactggtctacaatctctcgcacctttcttttccttccatctctcgggtgggaatatctctcccttgcacagctgaggtattctctctagaatcttgactgaacatatccttctagttaccaaattctctctccttcccttgatagtcaagcttatcaaccatcatagtgtccacttacttggccctcagtcaccaacccaggttaatctacccttcacttccatcagtaaacctaaagtataaggatcatgaaagctttccaaagtgcccaaatcagtgaacacgactcatgatatgtaactaactcatatctcatctagcttatatctccgtcatggacattgttggttgcatatccagtctctattctccctcttccttcctaaaagaactccattgtgttcatgaatgcattcctctcccctgtgattaagtgacgccaccctgggttgatcctgtttagtctaagccaatcagatcatggcattcctctgacaactgttacagggtcagacaactgacctaagttggtccaatcagactgaaggaccaagtgtgggagttttttctctctcctcctcctcttgctctagagaatgagaaagtgtgtatgttactagtagtcatcttgcaaccctaaaggaaaccaacctgactgtggaaacccaagaagagatgggtccttgatgacactggttttttttttttttttttttttgggacggagtctcgctgtctcccaggctggagttcagtggtgcgatctcagctcactgcaacctccgcctcccgggttcttgccattctcctgcctcagcctcccgagtagctgagactacaggcacccgccaacacacccggctaattttttgtatttttagtagagacagggtttcaccatgttagccaggatggtctcgatctcctgacctcgtgatccgcccgcctcggcctcccgaagtgctgggattacaggcgtgagccaccgtgcctggcctgacactgttgaccaactgaatcagagcctggaatccattcttcctctggactttgtgagagaattttccttactatttaagcagttgggttttcccagctgaaagcatcctaacatagccatttctccttgaaacttttctccctcgattttctaaacatcactcttttctgctcctacttctgcttctcaagtctggcctccccctttcctctgcctactcctacattttggtgtcctccaaggtttgttgtgatcttttctacccaaagtacatgttcacctgaaataatctcagttcagtcgggcgcggtgggtcacacctgtaatcccagcactttgggaggccaaggcgggcgaatcacgaggtcaggagttcgagaccagcctggccaacacatggtgaaactccgtctttattaaaaatacaaaaaaattagccaggcgtggtggcgggcgcctgtaatcctagctactcagaggctgaggcaggagaatcacttgaacccaggaggcggaggctgcagtgagccaagatcgcaccactgcactccagcccggacaacagggccagactctgtctgaaaaaaataataatgataacaataataataataataataatctcagctcactatgtctttcccttgacacatcaaaactgagcttccagcacttcccccaatggaataccactgatgttccccaccccttttacctgaagaactcctacctgtctcaaaactaaatttaagtgtcccgtctgtgaagccttctctgaagtccccaggggttccttacctttttttctgccgtggacctctttggccgtcagtgagtcctatagactccttctcaaaataatgcttctaattgcatacaaaaaagtcccaactatattgaaataatcttattttttaaactcaaatatctgatataagcagtatgtgcttctttactagcccactaaacaaaaagatctagcagtgagtcttataactaccatagttctgaagtagtaatgagcataagtgatattttgacatctgcaacaactgtaatgtaatatgaaaatgtctgtgacttgtgctggtactgtgacttctactggtaacaggtactgctaatactactgtgatttgttacagtaggaacttgtaaaatgaatggcccccagcgaagtgcaccaactcatatctatgaccttgtgtggttccccaccatatcaactctggacttggctacgtgacttgttttgacatcagcaaacatgatgctgtgtttgtgccttgggacttgccctcttggaagtcagtaaccaagtgaggaagtccaacctaggcacatggaggggcaccaagcccccagacatgggagtgaagccaactttcagtcaagtcaccagcagaactgcccagccaacccagattttgagaaacaattcttgttttaaggcactggtttgcagtgatttgttacccaacaatagataactgagacattacccatatgcgtaactaaaggaagtgctcaattccaattggagattgctaaaaatagttatgttttttccccatcaaagttcagggatcctctgaaatctatgtgcagatcctttgaggagctgagggccccaggttaggaacccctggttaagccaagtggatcctgctctcctttttactactttactacactgttggtacacatatagttaaactggccacagcatatctttccttgttgtaaccctgaaatggagctgagctcctagcacataacaggtgtttaacacacaaatttatcaaatgaatgttgattataggatctgtcttcctgactaaactgtgagctgcctgaaaacagagtaagagcaaatactaggccttttccaagtgctttacacataccaacttactccttataacaaccctatgaggtagatgttattaccccaacttcaccaaaggaagataggcacagtgacttgcccaaggtcacacagctagaaagtggcaatgccaggactagaaggcagaatgcatgttctgattttacagcctttattaacgtacccaaagcacattgcagagctcaataaaacttttaaatgaatagtacaattctgagatttcattagcactattttatgggtactatgcttcttgaagactcaattttgtagattaatttctggtagcctgtgattttttatgacaaaatacatataatttactttttaaaaagtagaataatggctttatgctaaagtgcagattttcgaaattaagtcttcatcgtaaaagtcgatttttttccaaaggacacgagttcacaaaacgcagggaagggggtccactggcccgtattaaataatgttccctgaggagtggagcaaagctccagcttccctcgtcacccagccatcccaccccagcctcccccataccctgcacagcttctcctaaaatgaccctcccccatccacacatcaggttctgaaacctgaccctgccaggcaactaaagccgcgaaccccacagtgccctgagctggcctcaccctacccacgatcccaagagggtactagccgaggggatgggtactttgggggaaggcactttaaattttcaaagtgtttaattcacgaaagcacaacccaaagggccgcccccacccacccgggggtctcccgcctccgcccggcagccgctcatccccagtagaccagtgaatgaaccgcggggccgggacgcagccggcccagtggcgggaaaagcctcggggtgagccaggcctggctgcagagaggccccaagagagcgcggggagggctcgggcggccgggagggggcggtgacagctgtgactcgactccacgctctcaccttgaacatgtcgctggcagcggaggctccggcagggtcaccccggcctcggccacgcccactatagagaggtgactacggaggcccggtagggccttgatttctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcggtaagcctcctctctggaaatcaaatgtttgtcccttaatacttgtagaagtaactgataatggcaataattatcttattaacaagagtaaacaagcactgatacagcactttgatatgcgcagccctgatctaagttctttattcacattcatctaatctttccaacaacggaagtaggtgggcatgattattattcccaatacatagatgaagaaactgaggcacgtagaagtaatttgtacaagaccacataggaagtgggaagctaggatccaaacccattagtctgcctttgaaacctgtgttctagccaaaacaattgttgcactgtctcataatgaggatgtatttcctatttcattctgtatttctgccctaatcctataaaaagtgtaagccccatccaggcgagcatctggaaaaatttagaatttgtacagtgacgtgccactgccctccagccaaagaccactaggggcacacctgtagttgaagaaattgggtttctcattgctgcaaggagaacgcacacgtaggaacacagtgacatatttcagtaaaagagttagatttattataggatttgggctttggttcggtgattttggggcgagttcaaggaagcaggagctttgctctggatcgggtgttgttaggaagcagtggtaacaccaaggcccagctgtgactgccagccttggtgttagttaagcccagcttagctcccagatgttaagggctgcttttctctttcttaagaggattgtatattccaaggcatccccaaggagaaatactgaatagactcagaaggctctctgcatcagcagtgtaacgtcacacatacataaaaatgtgaaacatattgataaattagggcagaagttcttaattcagggggtatgtgaacttgtatgggggaaaaaatgacaacttcattttcactaacctctaactgaactttgtttctttcaattatagtgtagataacaagccacagtagtattaacattgatgactttgtcatcaatggaaagcacagatattttcatgttacattgcagtcatgtcagggatcttgaaatatttatgctcgttactacaaaaatacagtagttattagagctcatttaatgcattaagaagacacatttactataattttgttttaaaaaatattttgatgatttcaatataattggagcaccttgtaatcctatgtattttatgttatgcgttttaaaaccaattcttagaagagatctgtccataggggtccatggcaccaaaagaaatgataaagagcccctggtttagtaacagagaccaagcagtgagtaagaatttgggagctgcatccaaattggagcattactgcatccaaactcgttgctttaaagaatagaaagttggaggtggaatcagaaatttagtgtataccctctcactttaccaaggagggaactgaaccactgagaggttaagtgacttgcccaaagtctcactgctatttggtgataaaactgggacaaaacgtttttagacaaacatgtaaaaactctccactgtgctaggcactgaggactctgtagttaacaagatgcctcctgccctcaatgagcttgttggtagacagctggagagtgaggagattgaattattgagttaaaaagttaactccaggtgtagtgtggaagatgaataagaggagaaaaagactggagacagaccagttagaaggctatggatagatttacttgtcttttccatataccatataatatttttagtacacaaagaatgtaaactgtaagcaactttaagagatccacaatgccttcctttttaaaggattcagaattagtacaacaatcatatggcacttgagtcttgtccaaacagtgtaatagtataaattatgacctcaaagggttaatttatgtactttcagattacttcattggagggaaaatgaatcgttcctcaaatgtaccacgtaaaggtattctgaaatcaggtacaagatccttacaaaaagttcgcagagtacatttcgcaaatgcacgaaatgcaagatcattactatcgtaagtacctgtgttttgccttgtgttatcttccacaactgtacagtttccaaacagtacttattcagataacttcaaatgcttcttgttttgtaaatcaaagtttttgtgttttaaaattactttcaaattgagtaattataattgcattttctaatttacaaagcatattaacacacatctacttgatcctgatacaaccttgtgaaacaatttttacattttataaatgaagtagtagcaaccgggagaaggtaagtggcttgcagaaagttatcagctaataaatggcatcagataggattcaaaggtttgtttccacacttcaggctttttcctttctttttttttttttttttttttttcagacagagtctcactctgccacccaggctggagtgcagtggtgcgatctcggctcactgcaacctctgtctcctgggttcaagcgattctcctgcctcagccttccgagtagctgggattacaggcatgcaccaccacgcctggctaatttttatattttcagtagagacggggtttcaccatattggccaggctggtctcgatctcctggcctcaggtgatcccacccgcctcggcctcccaaactgctggaattacaggcgtgagtcactgtgtctggcctagccttttcttctttatatcttgtagcctgcattttgccagccaatgggtagcattatgcaggagtacctgtctttgtacatagcgctgtaaggggtaatgatggggtgagaaggtatgaaggaggagacccctacaatctgccagtgctgggatatgatcaaaagtagaataattccgacttgacctggatgagcctggttcaagcaaagatcagagaaggaagtttctttttctagggcatagtcatccacccccagaagagaactgggcctcctgtaactttgactattccccattccattttcatagcacttgaactagttggacgtttcattttaggtcgtgaatgtttttgggaagtaagcttgtctcctcatactttttatttataatatacatgcctcttaatgatatatttatattttatatgccttttgatgacaaagttttggccaggacttttttttttaatctcaagggaaatctcctcaagtatttcatatcctcattctgagtagattctgcaaatgaccacttccaattaccacatccaaatgttcctcattaggtcagtcttagagtgggggatggggaggtacaggaggaggaagcataaattgatagttctctaaggttttaggaaaatgaaaactactttataaatattaacctctttttttctctcagaatgcttaaagacatttcagctcaaataatacagagggcttggttatctcatacaaacaaaatgatatttcgactcctaaaacacgcaatttgtgcagcggtatgtattttgcttatttttttctctgagggatttaattatcaagctaaaagatctattaattaaagatcgaatagataaccttctttatctcctcttttttttttttttttgagagggagtctggctctttcacccaggctggagtgcagtggcacaatcttggctcactgcaacctctgcctcccaggttcaagcgattcttctgcttcagcctcccaagtagctgggactacaggcacctgtcaccatgcctggctaatgttttgtatttttagtagcgatggggtttcaccatgttagccaggatgatctcgatctcctgacctcgtgatctgcctgccttggcctcccaaagtgctgggattacaggcgtgagccaccacgcccggccctttctttatctcttctatttggatctaataatatcacgtggagttctggaattgtttcttctgttagccctagatgagtatttctggattttttaaaatgtggatgactattacttttttctgaaattaatatactgcttgccttgttttgtttttaaatttgattccttatttgaaaatgtgagacagttctcttccaacaataaaaagctccgaatctgcaaggtgcagcatctcacgcctgtaatcccagcactttgggaggccaaggcagggagggccaggagttcgagaccagtttggccaacattgagaaaccctgtctctactaaaatacaaaaaaatagccaggcgtggtggcatgagcctgtagtcacagctacttgggaggctgaggcaggagaattgcttgaacccaggaggtggaggttatggtgagcggagattgcgccactacattccagcctgggcgacagtgagactctgtcccccttcaaaaagctctgaattaaaagttcccttaccttttatccagcaattttacttctaagaatctgttctacaatacatacacaatttgattgcaccgttgtttgtaacagcaaagggagtaaactgtataatatctattgatatgatgctggttaaataagtgttgctgcttttatagtgttaaactttgcagctttaacatgattctgcaatagaaaggaaatgaagatagctcatcagttaaaaaagcaagcaccagacagtatgaagagcatgatcctacttgagtgaaaaccaaaaccaaaaaaaaaaggtgcatatcccccctcctccagaaagcaactctggcaaccctagcagagccttccttggcatagtaccaaatattctaataaaacaacctataaatccagtagtctattattagtgatactcttttttttcttttcttttttgagatgaagtctcactctgttgcccaggctggagtgcagtggcatgatcttggctcactgcaacctccaccacccaggttcaagtgattatcctgcctccgcctccctagtagctgggactacaggtgcgtgccgccatgcccagctaatttttttttttttgtacttttagtagagacagggtttcaccatgttagccaggctggtctcaaactcctgacctcaggtgatccaccctccttggcctcccaaagtgctgggattacaggcgtgagccaccacacccggccaattagtgatactcttaagggaattttagcagctctgaaaaaaataataaagtctgagcaatgtatacaccgttcaccatctgacccacagacctatttctgatgtcagtaaaagcagaatacggctgggcacagtggctcacacctgtaatcccagcgtgagctgggatctttaggaggccgaggcgggtggattgcctgaggtcaggagttcgagaccagtccggtcaacatggtgaaaccccgtctctactaaaaatacaaaaaaattagccgggcatggtggtgtgcgcctgtaatcccagctaccttgaaccggggaggtggaggttatagtgagccgagtttgagccactgcactccagcctgggcgacagagcaagactccgtctgaatacttcagagaaaacccacccaggtaaactcctggcatttcaggtctattatccattgtctttgaatatggaacttgtatttaattttataatgctggtttcatagtatttttagacttttgtaacagaaggaaattcttttttatctgttatagtaatactttaataccttaaattaataatgctttgtccttttaaaagctatttatttatttattttgagacagagtcttgctctgtcacccaggctggagtgcagtggcacgatctcggctcactgcaacctctgcctcccgggttcaagcgattctcctgcttcagcctcccaaatagcttggactacaggcgcctgccatcacgcctggctaatttttgtatttttagtagagatggggtttcaccatgttgaccaggttggtctcgaactcttgacctcaggtgatcctcccgctttggcctcccaaagtgccaggattataggcgtgagccgcagtgcccagcctaaaagctctttagtgtacatttttatgtgattatcataggcataacggggttggttggggttgtttgggggaaagagttgggactttagagtcaaacagaactaaatgaatcctggcttccccattcactacctgtatgcctttttataaattacaaaaattccctgagcctcagccttctcatctgtaaaataggcgtgataatattctcataatgggccaggtgcagtggctcacgcctgtaatcccagcactttgggaggctgaggcgggtggatcacctgaagtcgggagctcgagaccagcctgaccaacatgaagaaaccccatctctattaaaaatacaaaattagccaggcatggtggcgcatgcctgtaattccagctactcaggaggctgagcaggagaatcacttgaacctgggaggtggaggttgcggtgagccgagatcatgccattgcactgcagcctgagtggtggctcacacctgtaatcccagcactttgggaggctgaggcgtgcggctcacaaggtcaggagttccaggccagcctggccaatatggtgaaaccccgtctctactgaaaaaatacaaaattagccgggcgtggtggcaggtgcctgtagtcccagctactcgggaggctgaggcaggagaatcgcttgaacctgggaggcggaggttgcagtgagccgagatcatgccaccgcactcgagcctgggcgacggagcgagactctgtctcaaaacaaacaaaaaattctcatagtgttgctgatgtaaggattaaatgagctaatgtatataaggcacctaacatagtagtatatggtacataaaaggtgcttaaaagctagtaacttattactattatcatcctcatcttacagtgattcattcaacaaatacttcttaagcatctgctgtgttccaggcactgtattagatgctaggaatatagtggtaaagagaaaagccaccatccctaccttcatgaagcttacagtctagtaggaggcacagacaagttgataagtaattataatatattgtgaaaagtgctgtcatagggaaataatagtgcctttgatctctaaaagggacagataaccaaagttggaggccaaaatgattaagtaactggctcaaggctacacagatagtaagtggaggtgccaaaacaaaaacccaccccttcagaactccaagtccagcataatgttcactttaccacgttgcctctgttatagtccataaattgtgtctgggtgggatactgctttccttttacagcactgtcctttatttcaggaattctatgtaacacatgaaatactgaagaaagtggcccccttagaggctaagcttattaaggatcctactatgcagtgtaaaattagattcaggtaatgtatctatgctgatttatttcaagaagtacttagttaatatgaggaaatcttagatatggattttttaaattcttgtaacttctcagaacttaattacaaagtaaatgtgttattcttatttacatttgttatgtgaagaaaccgaggcatgactctgtggctaaaagttgccatgagagtagctctcatctcccattctgtattcagtcttacacaggtatgagaatagttgtgagtacaccaaagtgtgggtcttacatcctatgtgatccatttcattaccaattctttacatgctctgacatagcctttaccctgtatgcaagaaactatatgaactatcttaagtataagggggaaaagcaactgagcccaaaacctgatgccaaataactaaatttttatctttatttcagatttagaggtgaaacgtttccacctttcatcgtgtttaaaatttttcttcatactgatggccatggttacaagtattttagtggaaaaaatgtattaatgccgtcaagtaaggtgacgtttcatgatgtacattttatgttaacttagctttttaacatctacatagtatctgaattgcattcaaattatacagaataagttatttcaccatgaaacagcccaccaggtaggtagtgtgtttttttttaagcaccatgtttcaaagtgtctccacttactagctaaaaaaaaaaaaaaaaaagacatttggagtgaattacttaattaaggctctagaaaatatccatccatttttatgtattaaaatttttatttgttaataatagactaggccaggcgcagtgactcatgcctgtaatgccagcactttgggaggccgaggcgggcagatcacctgaggtcaagagtttgagaccagcctggccaacatggtgaaaccccatctctactaaagatataaaaattagccaggtatggtggcacatgcctgtaatcccagctgctcgggaggttgaggcaggagaatcacttgaacccaggaggtggaggctgcagtgagccaagatcgtaccactgcactccagcctgggcgacacagtgagactctgtctcaaaaaaaaaaaaaagactaaaattggtcagggctcttaaattatgcagaacatttaatttaatgccattttatttgttttaatggaatgttattatttctttgattctggtagcacatttagaaaaaaaatggtctggactatgctattgaaaatgaactttcagccaggcacggtggctcatgcctgtaatcccagcactttgggaggccaaggcgggcgaatcacctgaggtcaggagttcaagaccagcctggccaacatggtgaaaccccgtctctactaaaaatacaaaaattagccaagcgtagtggtgcatgcctgtaatcccagatactcaggaggctgaggcaggagaattgcttgaaccctggaggcagaggttgtggggagctgagatcgcaccactgcaccccagcctgggcaacagagtgagattctatctcaaaaaaaaaaaaaaaaagaaagaaagaaaatgaactttcaaatatttatccttttttcacatgaattctcatcatacttatttatttctttatttattttgagacagagttttgctcttgttgcccaggctggagtgcaatggtgcgatctcagctcaccacaacctccacctgccaggctcaagtgattctcctgcctcagcctcccaggtagctgggattacaggcatgcaccaccacacctggccaatttttgtatttttagtagagacggggtttcaacatgttggccaggctggtctcgaactcctgacctcaggtgattcgcccgcctcggcatcccaaagtgctgggattacaggcgtgagccaccacacctggcactctcatcatacttttaagtttcatgaatattcaccacaaattgtgtctacagtataggaatcacctgggaatcttgttaaaatgctgccgctgctgctggtccataaaccacactttattttattttattttatttttttgagacggagtctcgctctgtcgcccaggctggagtgcagtggcatgatcttggctcactacaagctccgcctcccaggttcacgccattctcctgcctcaacctcccgagtagctgggactacaggctcccgccaccacgcccggctaattttttttgtatttttagtagagatggggtttcaccatgttagccaggatggtctcaatctcctgacctcgaaaccacactttttttaaaattcattcagccactctatatcttttgattggagagtttagtccatttacatgaatgttattactgagaagtacagacttagttttgccattttcatatttgttctggttgttttgtggtcttctcttccttctttccttccttcctgccttccttttagtgaaggtgattttctctggtggtatgttttaatttcttgctttttattttttgtgtatctgttgtatgttttgggatttgaggttaccatgaggcttgcaaacaatatcttataacccattattttaaactggtgacagattaacacagattgcttcaacaaacaaaaaaataacaaacaagcaaagagaaaccaaataaaaactctgcactttaacttcatctccccactttttaactttttgttttttctattaatatcttattgtattgtctatgtcttgaaaagttattgtagttattatttttgatcagttcatcttctagtctttctattcaacatatgagtagtttacacaccacaattgcaatgttataatactgtttttctgtgtacttactattaccagtgaattttgtactctcagatttcttattgtttattaatgaccttttctttcagattgaagaattccctttagcatttcttgtaggacaagtctgttattgacaaaattcctaagcttttgtctgagaaagtctttatttctccttcatgtttgaaggatatttccactgcatatactattctaggataaaagtttttatttttccttcagcactttaaatatgttacatcactctctcagcctgtaaggcttccaatgagaagtctgctgccagacgtattggaactcctttgtatgttgtttgtttcttttctcttgctgattttaggattctttctttatccttgacctttgggagtttgattattaaatgccttgaggtagtctttgggttaaatctgcttggtgttctgtaaccttctttacttggatattgatatctttctctgaatttgggaagttctctgctgttatccctttgaataaactttctaccctgatctatctctctacctcctttttagggccaataattcttagattcacccttttgaggctattttctagatcttgtaggcatgagtcattcttttttatttgttttcttttgtctgctctaattgtgtattttcaaatagcctatcttcaagttcactaattcttctgcatgatcagttcctctgttaggagactctgatgcattcttcagtgtgtccattgcatttttcagctccagaatttctttctgctcgattatttttaattatttcattctctttgttaaatttatctgataggtttctgaattccttctctgtgttatcttgaattttgttgagctttctcaaaacagctattttgtttgttttttgtttttttacgtcagaacatgaacacaaaaacagctattttgaattctctatctgaaaggttacatacctctgtctctctaggattgatcactggtgccttatttagtttctttggtgaggtcatgttttcctgaatggtcctgatgcttatggatgtttgccaatgtctgggcatcgaagagttaggtatcgtagtatttactgtagtctttacagtctgcgcttgtttgtaacctgtccttcgtgaaaaggctttccaagtattcaaagggactcaggtgtcgtgatctaaatctttggtcactgcagccatatctgcattagggggcaccccaagcccagtaacactgtggctcttgcagacttgtagaagtactgccttgttgttcttggctaagatccggaagaattccctggattaccaggcagagacttttgttctctttccctacttttcccccaataaatggaatctctctctttctgtactgagcagcctggagctgggggacgggtaaaacaagcacccttgtggccaccaccaccactgggactgcactgggtcggacctgaagcaagcatagcactgggtctctcccaaggcccacagtgaccactgcctggctaccatttactcaaggcccaagggctctacagtcagcaggtggcaaatccggataggcttgtgatgtaaaccacacttttaatagcaaggctctacagtacaggttttactccttggacccttatacatgactatatttaagttttaaaaagatggacattctcatatttggccatttataaaccacatatcaaaggttatttttctgtaaccctggcaagatcccccttctggaaatgtacacaaaaactgtggcccatcttaaatcatgagttctagcatgtatgcaggagagaagaccacacagcctggcagtttctgatcagatcctgcatgtgcggcattgactctgaagagttttagaaaaggaaaagggaccacttttctccatgttctcaggtagtatcagagaaaatttaactttatttcagaaaattatcaaatgaagccaggctcggtggctcatgcctgtaatcccagcactttgggaggccgaggcgggaggataacctgaggtcaggagttcgagaccagcctggccaacatggtgaaaccccgtttctacctaaaatacaaaattagccgggtgtggtggtgggcgcctgtaatcccagttacttgggaggctgaggcaagagaatcgcttgaacccaggaggcagaggttgcagtgagctgagattgcaccattgcactccagcctgggcaacaagagcaaaactccgtccaaaaaaaaaaaaaaaacacctagaaaatgagctacatgttttcattatggaatatggtgtttcaagaacattaatatttatatagatcaacttcaaatgtggaagtatatgtttatcctacttgaaggataaatttatgccacatttatgtatagaataagcttgtagttacccctataaaatatcatcaattgtttctttcctaggattatataatgaggctttttcaagaactgaaatcctcctgggtctactcctgccacccccttgctgtacacaggcttgagcaaatgagaaccttagaggcagtgattggaaatcactgcttatgcattaaaacccatcataatgctgtataataacttaaatttttgtttaaattagcccacagatagaaaaatatgcctccgtgcctttatcttctgtgctacaactttcactctcctggggtagtcattgttaatggtttgctgtgtatccttcatgtttcccatgaaaatacacacatagagatttttaaattttgttcttattataaaagtgtggtcatattattgaccttgaatttttcactaaacatcataacgggttttaaatgatcagaacatacccaacttgaacagtttaaggttcctttttccctttagttcagcttcaaactctggtaacacttggattcatggttgatagaaaacttgtaaatatggaatatttctcactctaagcttactcaactctgttgctctttgtctctttgtgttttttgtttgtttttgttttttgtgtttttgttttttgttgttgttgttgttgttttttagacaaggtcttaatctgttgccaaagctggagtgcagtggcaccatctcgcaatcttggctcactgcaacctccccctcccaggctcaagcaattctcatgtcttagccagctgagtagctgggattacagacatgtgccaccatgcctggctaatttttgcatttttttttagtagaaaggaggttttgctatgttggccaggctgatctcgaactcctggcctcaagcgatctgcccacttccgcctcccaaagtgctgagcctactgagcactttctatcaaatatgatcttaaacattttatgcacattactctatttaattatcataaacactacagtgtattttctgttattatcctcattttaaaaaagactgagggccgggtgctgtggctcacgcttgtaatcctaacactttgggaggccgaggcaggcggatcacttgaggtcaggagtttgagaccagcctggccaacatggtgaaacccatctctactaaaaatacaaatattagccaagcgcggtggcacgtgcctgtaatcccagctactcgggaggctaaggcaggaggatcgcttgaacccaggaggcggaggttgcagtgagccgagattgcaccactgcactccagcctgagtgacagagtgagagtctgtctcaaaaaaacaaaaacaaaaacaaacaaacaaaaaagactaacttgcctaaggtctcacacctggaaaatgaaggaaccgagatcaagacctagtagcctgcctccaaagtcccagttcttaaccactcctgagagttaggaactatgctaaacagcagcatacacattctcttagatggccctgcaataactctggttagggacacattattcccattttccctattaggaagctagaagttggaaagacttgccaggagcataactgagacttgaacacttctctgtgtttccactgtactatgtacattttgaggttaaaacaaccatgcagttatggtggttttgtttattctgaacctgtatgtaattggactgttccaaaccaagaaactgttccaatgcatggataccagttattacctcttccatgagtgacagttcccagtagaaacaggaaagtgtcttgagatactagagtagctttacaagcccaagtgtggatctaggccagcaaatagccacagagctgtgggggcttctggccacagagatgctgagtatcaggataagtgccagatttagagatggcccgctttgacgctttgagtcacccactaagaacagaacctgcctcttgaatcctaccctgattggctggtatcctggaatctttgcctagtttttgcccttgcttttctcctggctctaggctcttctttcccattgcttcctatggagaaggactttcttgactttggccatacactgcagatgtctgagaaagaacatcttggccattggacagcaaacatttctcaaacccctctcacaggtgggcagagagcttgccctatgctgccaggcatgtttttctttggctgagggaccagaatgggccagacacagatgaggcacacaactgaggcactgcacacataaggaaactgggtcttggagagattggtggtggtggctgagtggggcagtgtagggaggacctgtcaataaatacctttttggggaggctaaggtgggcggatcacttgaggtcatttcaggaccagtgtggccaaaatggcgaaattgtctctactaaaaatacaaaaaaaaaaaattagccaggcatggtggcacgcacctgtagtcccagctactcaggaggctgaggcaggagaattgcttgaacccgggaggcagaggttacagtgagtcaagatggcaccactgcactccagcctgggcgatagagggagactctgtctcagaaaaaaaaaaaaaaaccctaaataaataccttttgtactgtggctcacgcctgtaatcccagcactttgggaggccaaggcaggcagatcacctgaggtcaggagtttgagaccagcctggccaacatggtgaaaccccatctctactgaaaatacagaaattagctgggcgtaaccccaacactttgggaggccgaggcaggtggaacagaagatcaggagttcgagaccagcctggccaacatagtgaaaccccgtctctattgaaaacaaaaattagctgggcatggtggtgcacgcctgtagtcccagctactcaggaggctgaggcaggagaatcgctcgaatccagaaggcggaggttgccgtctgccgaaatggcacctctgcactccagcctgggtgacagagcaagactccgtctcaaaaaataaaaataaaaattttaaaaacccttttttagtaacttcagctaaagtaaattatagttatgcctacagaaattcctaaagcagaaattatatggtcttcatacctgttcagtgtacaattacttgtttttacctttagtgtcactgtggggctggttaattagaaccataaaatgttggaaattaattgcaagaaaacataatggagagatttgccaatactatctttattttatttatttatttatttatttatttatttatttatgaggtggagtctcactctgtcgcccaggctggagtgcagtggcacaatctcggctcagtgcaacctccacctcctgggttcaagcgattctcctgcctcagcctcccaagtagctgggattacaggtgctcaccaccctgcctagctaatttttgtgttttttagtagagacggggtttcaccatgttggccaggctggaatcgaacccctgacctcaggtgatccacctgctttggcctcccagagtgctgggattacaggtgtgagctactacacccggcctatcttttctttagttgtgtaatgtataaagaaatttgttgtggggatgagggaggggggagggatagcattaggagatatacctaatgttaaatgacgagttgatgggtgcagcacaccaacatggcacatgtatacatatgtaactaacctgcacattatgcacatgtaccctaaaacttaaagtgtaataataaaaaaagggaaatatttatggttatggaaatgcttgccctgataaaaatcctacatattgtttttttaaattcacattttatgcttatacaatctctagagctcttactatgttgctataagacagtaatatagtgataatttaccaactttattgaaaatgttgttacatcaataaaatagcatgctggaaaaaaaagaagaaattaatgaaatataaagcaaaaatgatctacctaaaggaaagctccatatcacattttcactaaactgtttgtctcttcagttctatacgttaggaataaaacttcaaccattcaaccatttgaatgttttcttcctttttcattttctacatgtgtctgtgatattctaagctttggaatttaaaaaaataaataaaggaatagtctgaataacaaaagtgagaattggaatagaaaatgcattatagcttgctgttgtgtgttaagaaaaaagaacagtgattctcagttttgatcctgtctcaaccactctttcttttctctttttttttttttttttttgagacagcatctcactctgtcacccagactggagtgcagtggcatgatctcagctcactgcaacctccacctctcaggttcaagcatttctcctgcctcagcctcccgagtagctgggtttacaggcacatgccaccatgctaggcaaatttttgtatttttagtagaaaaagggttttgccatgtttgccaggctgatctcgaactcctgacctcaggcgatccgcctgcctcggccttccaaagtgctgagattacaggtgtgaaccaccgtgcctggcctcaaccactcttttaggccttgtatcaacattataacagagttcccatactttcacaaataccgcattctgacatacaaaggaagaaagaaacttaactggaatcaaaagatgtttgaattttcttttcttttcttttcttttttttttttttttttttgagacagagtcttgctgtgtcccctaggctggagtacagtggcatgatctcggctcactgcaacctccgcctcctgggttcaagcgattctcctgcctcagcctcccgagcagctgacattacaggcacctgccaccacgcctggctaatttttgtatttttagtagagacggggtttcaccatgttggccaggctggtctcgaactcctgacctcaggtgatccacctgcatcggcctcccaaagtgctggaattacaggagtgagccaccacgcccgccctgaattttcttttgtgctatccttcccttcatataaacataccctttgtggccagaagtacagatctgtaatataaatatgtgttagaagagtcagcacatacttatggcgggggtgcagagtacttaagtctctactcacagtctatgtatagctcttagcacaggatacttatatgtggaagggtatggtataagtagggcccaacaggatttgagcttccatatattctgtgattcttctgtctctgacctctcaggtgctttccttgagcataaaatgttgacatttgggagagaaaagaaaacccctctatttgccactttttagctgctgagaatgaagtctgaagggagggaggcttaaacagtctgaaacatacatgtttccacttaccagcagtgtattaacacataaaagagaggtggtactagtgacacctttcattgcagttcctacggtaactcgttgaatcaccagataagttttctctgcattgactgcacgaatgatattacaggtttgttttgcttttcaaaataaaagaattaaaagtcttttaaggggaaaaaccagttgttttaaaactatgttctctgaggattctggactcagcaattcctctagctgcatttaaaaactatgtagatggcctggcgcggtggctcacgcctataatcccgcactttgggaggccgaggtgagcggatcacgaggccaggagatcgagaccatcctggctaacacggcgaaagctggtctctactaaaaatacaaaaaattagccaggtgtggtggcatgcgcctgtagtcccagctactcaggaggctgaggcaggagaatcgcttgaacccaggaggtggaggttgcagtgagctgagatggcgccactgttctccagcctaggtgacagagcaagactccgtttcaaaaaaaaaaacctatgtagataaggctatggaaacaattttaagtggtttaataatccctatataatctctttgcaaatgcagcctttctattgaatagcaagctgctagaagaaaggaacaatatttgatgtatttgtcagaagaaatatgtaaagggcgtgctgatcattaatgctattctactatttttaaagtctattttctattctttttacaggcagtggatgatgcttgcaaactaatgggggaaaggaaatttcaccgtataattatggaagatgaacgtattttcccgaagtccaaagtaactgatataatggatgttgtcaccatgcaagattatgtacaagtaaggaatttagatttagaaaaacaaacaaacccagcaagtcttcctaactctgtcatccaagaagatagaatcatacttttttattatggtaaaatataacacaatataaaatttattattgtattatattttattttatttttcaaatatattctatagaatgaaacttattttcggatgcccaagcactagaactttcttttaaaatttttttttaatttaacttttattttaagttcaggggtacatgtagaggtttgttattgtatataggtaaactcgtgtcaagggggtttgttgttcagattattttgtcacccaagtattaggcctagtatccattagttatgtttcctgatcctctccctcctcccaccttccaccctctggtaagtcccagtgtgtgttgttcccctctatgtgtccatgtgttctcatcataaaattgaccattttaaagtgtacaattcaggggcattaagtacattcacagggttgtgcaagcatcaccaccatctagttccagaaccttttcattaccccgaaaggaaaccctgcatccagtaagcagtcactctccattcctgcatcattccagccccataaaccaccagtctgcattgtctctatggatttgcctaatccggatatttcatataaaggaaatcatgtgatatatggctttttatatgtagggagctaaggaatttgggggttcttttggggtgatggaaatattctgaaatattcataggcagtggtgatagttgcacaacattgtgaatatactaaaaaccattgagttacatactttttttttttttgagacagagtttcgttcttgtcgcccaggctggagtgcaatggcgcaatctcagctcactgcaacctctgcctcttgggttcaagcgattctcctgcctcagcctcccgagtagctgggattacaggcatgtgccaccactcccagctaatttttttgtatttttagtagagacggggtttcaccatattggccaggctggtctcaaactcctgacctcaggtgatctgcccgtctcggcctcccaaagtactgggattacaagcgtgagccaccacgcctggccgatgttgtgttttcacaaatggaaggtttgtggcaaacctgcatcaagcaaatctatcagtgccatttttccaatagcatgtgcttgctttgtgtctctgtgtcacgttttggtcattcttgcaatatttcaaatcttttcattattattatatctgttatggtgaactgtgatcagtgatctttgatgttactattgtaattgttttggagcaccacaaactgagcccatataagatggcaaacttaaccaataaatgtatgtgttctgactgctccaccaaccagccattccattatctctctctttcccctctggtctctctattttctgagacacaacaatattgaaattaggccaattaataatcctacagtggcttctaagtgttcgagtgaaagagtcatgcgcctctcactttaaatcaaaagctagaaatgacgaagcttagtgaggaagtcatgtcaaaagctgagataggccaaaagctagacctttgcaccaaagagttaaacgtgttgtgaatgcaaaggaaaaatttatgaaggaaattaaaagtgctactccagcgaacacacaaatgataagaaagcaaaatagcctcattgctgatatggagaaagtgttagtggtctggatagaaaattaaaccagccactcacgcctgtaatcccagcactttgggaggccgaggtgggcggatcacgaggtcaggagatcgagaccatcctggctaacatggtgaaaccccgtctctactaaaaatacaaaaaattagccgggcatggtggcgggcacctatagtcccagctactagggaggctgaggcgggagaatggcgtgaacccaggaggcggagcttgcagtgagccgaaattgcgccactgcactccagtctgggcaatagagtgagactgtgtctcaaaaaaaaaaaaaaaaagaaaaagaaaaaaaaagaaaaaccagccacaatattcccttaaaccaaagcctaatccagagcaaggccttaactctcttcaattctatgaaggatcagagaggtgagaaagctgcagaagaaactttggaagctagcagaggttggttcgtgaagtttagggaaagaagccgtctttataacataaaagtgcaaggtgaagcagcaagtgctgatggagaagctgcagcaagttatccagaagatctcactaagataattgttgaaggtggctgcactaaacaacagattttcaatgtagacaaaatggccttatactgttagaagatgccctctagggctttcacagctagagaggagaagtcaatgcctggcttcaaaggacaggctgagtctcttgttaggggctaatgcagctggtaactttaacttaaagccagttctcatttaccattctgaaaattttagggcccttaaaaattatgctaaatctatccgggcggagtggctcaggcctgtaatcccagcactttgggagaccaaggcaggtggatcacaaggtcaggagatcgagaccatcctggctaacaccgtgaaaccccgtctctactaaaaaatacaaaaattagccgggcgtggtggtgggcgcctgtagtcccagctacttgggaggctgagccaggagaatggcgtgaacccaggaggcggagcttgcagtgagccgagattgcaccactgcactccagcctgggtgacagggcaagactctgtctcaaaaaaaaaaaaaaaaaaaaagaaaaaagaaatatgtttcataaggctatagctgccatagacaatgattcccctgatggatctgggtaaagtaaaatttaaaaatccagaaacgattcaccattctagatgctattgagaacattcatgagctgggcacagtggctcatggctgtaatcccagtactttgggaggctgagattggaggatctcttgaagatggagtttgagaccagcctgggcaatatagggagaccctgtctctacaaaaattaccccccaccccaaaattagccaggtgtgatggtatgcccctatggtcccagctactcaggagactgaggtgggaggattgctttagccatgattgcactccagcctgggcaacagagtgagaccctgtctcaaaaaaaaaaaaaaaagccacagccaccccagtcttcagcaaccagtaccctgatcagtcagcagtcatccacatcaaggtaagactctctaccagcaaaaagaataggactcactgaaggctcagatgatcattagcattttttagcaataaagtattttttttctttttgtggagatgggatcttgctatgtttcctaggctggtctcgaacttctgggcacaagtgatcctgtcagctcttcctccgtaagttctggcattgcaggcatgagccattatgcccagccataacaaagtatttttaaattaaagtatgtacatttttttttaaataatgctgttgcacacttaaactacagtataatgtaaacataacttttatatgcactgggaaaccaaaaattagcatgactctatttgtgatatccactttattaccatggtctgcaactagacccacaatatctctgagatatgtctgtatacagccttaactattcactcatttgcttcagtgtgaaacatgaaattaatgcagtgccttagagactcccaattatgttttctttcttttagagtcttagactgtgagtttagggaagtgaaccaggaaatgccaactatctttgctaaggacaaagaccacatactttcagattgtgaacatgtcaaggattaatgtcatagagaggagtccccagatagacatactggaagagagagataagatcattgttgacgtttgagtccttatacgggtgtggcactgtctttagcactttacatgtgtgttatcttctttcatcttcaagtttgtaaattctgtgaccttttttacaaatgagaaaaatgaagtttaacaagcctcaaaaaaacttgcctgaggtcacagacagatctgataagtggcagagcagatgattgacagatctatgatatttacccattttactacttcactcaggaaaaaaaatacccagccttactttgcatggcagtgcaggaccataaaaatgaccagcaaattgaaaccatgcaaagcaaacttaataatttgtggggaaaattgtgattgtcctgtgacttttcaaactttttgtctgtagtcccagctacttgggaggctgaggcaagaggatcacttaagcccaggagtttgagggtagcccaggcaacatagtgagaccccatctctgaaaacaaaacaaaacaagcttctttgtcaaaacattaaaaactcttttgctgtctgttataaatacataggaaaatgaaagaaaaaaacccaacacatttagaacacttttagtacactataatttaaaacattagaaacatagacaaagtgtttagtttcttcataaaatatcttaccaactgtgaatatactggaaactattgaattgtacactttaaatggtgaattgtatggtatgtgaacctcaataaagctgtgaaaaaataacttaccaagagtactttaaacagtgcttgccttcttgttcttctagtataacttataagcatcttttctatgtcttgatgtattgtcatattccttttaaaatttggatcagctgccaacattttattctttgcactttaaatgttgcaaaatatctcagagttccttcagtatgaagttttttttggccagcatcacttccactgggaaagcttcatctttttatcatagccactttcctcatttatgttgataagttcatcctcaccaagttcctctagctgtagatctgcaacgtcttgaatgatggcagtgttagcattcccacagtcacctgtttcttctagaactccatgtatgattgattccaatttcacttcaaggggtaccactttttgtttctttgacggggaattccctcttttgattttccatttttgtaaaatgtcacatgggtttatcattgggagacaaaaatgcaacacaactatatacgttgctgtttgtgtgtgaaatgaataacagattcacagtgaccagtcactgattgactttggaaggtatgacatgatttgtcactaatcatgatgatcatctgtcatttatattgtgatctttgagctgaagagctagcaacaggaggccgggcgtggtggctcatgcctgtaatcccagcactttgggaggccaaggtgggtggatcacttgaggtcaggagttcgagaccagcctggccaacatgatgaaaccctgtctctactaaaaatacaaaaattagccgggcctggtggcacacgcctataatcccagctacttgggaggctgaggcaggagaatcgcttgaacccaggaggtggaggttgcagtgagccgagattgcgccgctgcactccagcctgggcgataaagcaagactccatctcaaaaaaaaaagtttgaaaaggccgggtgcagtggctcatgtctgtaatcctaacacttggtgaggcagaggccggaggattgcttgagcccaggagtttgagacctgcctgggcaacacagcgagaccccattctccagaaaaggaaaaaaaaaaagatgaaatggtgcaaaggtaggattgcctgtgtgtgtgtatgtgtgtgagtgtgtatgtgtatatgtgagtgtgaaggtgtgtgttgagagtgtgtatgtgcatctgtgtgtgtgtgtttgaaagcatgaatgtgactgtgtaatataccctaaaggccttcttgttattctgtttcctagcactgtagctcctcctgccctatccctggctcttaaatgcacgactataatgttaaagtgatgatatatatttgtatttttaattcctaatttgatatcattttaaattggaaaaaaagaaaagtgggatttctacaaatactccaaaggaaaatagtgaaaatctccacttcatactagagatgaactcatatttctaaaaaggtttgtgcaaaagtcctctcaacagcctgggcaacatagtgagaccctatctctacaaagattaaaaaattggccaggcgtgatggctcacgcctgtaatctcagcactttgggaggccgaggtaagtggattacctgaggtcaggagttcaagaccagcttggccaacatggtgaaaccccatctctactaaaaatacaaaaaaaattaaccaggcatggtggcatgcacctgtaatcccagctgaggcaggagaatcgcttgaacccaggaggcggaggttgcagtgagccgagatcgtgtcactgaactgcagcctgggcaacaggagtgaaactccgtcccccccaaaaaaaaaaaaaatagccagacgtggtggcatgtacctgtagtcccagctactcaggaggatcactggagcccaggaggttgaggccgctagccatgatcatgtcactgccctccagcctgggtgacaggatgagaccctgtctcaaaaaaaaaaaagtcctctcaacccaagcatgtcatgaacaagctctactaggtatgcagaacacatagctattatcattaatttttaggcccatctgagtttaacttatctgagttatatttgccataaaaatgttgatgcattaaataaatatttagtgagtatgatactgtgtgcatgataatgtgtagcatagctcctgccttccaataagggagctaagtcatacacagataactaaaacattgagtagtcagagagagatcccaataaaattcagagatgggatcaaagaatgccttttggatgaagtgacatttgagtggaaccatgagaaatgtgtctaaaaacattttagagcacccacaaccaatcaattttttttttgagacagagtcccactctgttgccccggctggagtgcagtggtgcagtcttggctcactgcaactgctgcctcttgggctcaggtgatcctcctgcctcagcctcccaagtagctgggactacaggtgtgcgccaccacgcccagctaatttttgtatttttttattattatactttaagttctagggtacatgtgcacaacgtgcaggtttgttacatatgtatacatgtgccgtgttggtgtgctgcacccattaactcgtcatttacattaggtatgtctcctaatgctatcaggtttcaccatgttggccaggctggtctcgaactcccgacctcaagtgacccacctgcctcaggctcccaaagtgctgggcttacaggtgtgagccaccgcacctggccaactaatcagtcttaattgttttttttctctttttcttttcttttctttttttttctctttgagatggagtcactctgtcacccaggctggagtgcagtggcgcgatcttggctcaccgcaacctccgcctcccgagttcaagcaattctcctgcctgagcctcccgagtagctggaaccacaggcacaagccaccacgcctggctaatttttgtatttttagtagagatgggttttcaccatgttggccaggctggtctacgaactcctgacctcaggtgatccacccgcatcagcctcccaaagttctgggattataggtatgagccaccgcacctggccaacttaatcgttcttgttttttccctacagtatcgcagttttttcgatgaggcccctgcattttctggcggcagaaataacagctggcgcaaattaaatcttgaaaatattcccaggacaatgctaatgtatgacatagttcattattcagagtctggagtgatctcaaaccgtctacgaaatgaaatgaagtttctgttacagagaccagtaacgcaagagatccataagcaccagctacggattgtttctgaaattaggtaaaacagattcttcactggggttacaatactaggggcatatctgaaaatgttcacattctgccagatagctcactaaagataagaggatatatggggaaaatagggttggggcagattgctcaaaacgtatgcaattttgtaaacagagcactaacaaaaaggacaattggtacttggggagttaacttgtaccaccagacaggcagctcagtgtagctggaggctgccacagaaaatataaaaaaatgaacaaccatagagtggagatgctggcaactctttcattagagcagttagtgggcatggagacagtgcacatggaagtgggaccccaggccagcgtagttgccttttttttttttgagacggagtctcactctgttgcccaggctggagtgcaatggcgcaatctaggctcactgcaacctctgcctcccgggttcaagcgattctcctgcctcagcctcctgagtagctgggattacaggtgcccaccaccatgcccggctaatttttgtatttttagtagagaatgagtttcaccatattggccaggctggtctcaaactcctgaccttgtgatccggccacctcagcctcccaaagtgctgggattacaagtgtgagccaccatgcccggccgcatggttgccttttaagtggacatgagaggcagtgcgatctgccgagaaccaggagccatccaaggctggagtgggggtaggggaggagtagggtggagggcagtgagggtgagttgggggtggggtgtgcctctctgggaagacagcacttgatgcaggtgctcatttttgttttcatgaatacagtcaaaagggctccccttgcccatgcagcacagaactgagggctttttccttttttgctgaaggttataattctattcttgctactctggctccccttgcctgagataaattgcatataaattagagtgacgtcattcccctttttaccaatagtatgtgagccagttcacattgtagaaatggatgttgtagcaaaatagatgtattatgatctgaaacaacatggacagaatataacaactccaattatattccttttctctttccattactaagcctcacttagcccatcttatttacaaattaagctgctttcttaaaagaagaaagagataataatatgtaagaggacctactggtaatctattttcacactcttataattgaaatgaaaaatactccctttgtacatgaagaagacactgatgacccactgtcaagcaaacatgctggggattttttttcaggagtagagatgagtgattctgacccaataacataatttaacccatatattttatgatcaaggctatacatttgccagacagatggcctggtttagggcacagtctgtcatgaaatagattttctctaactcatccatatgagcactgaatatagaatttaaccctattaccaccaaggtcaaataaatgatgtaattttctctgccaccatatataatcctgatctccctgctatttggatttatcctactgagtatccaagaataagtaatttaagagccaaataattagccaaattattaatcaattgaagagaaaaaatactttcataaagccatctttgaatgcagttgtagtttagcatctcccagaagcaaaccctgagacagagatttaggaggtgatcccaggaacaactgaagggagagggtaaaaaagtggaaggcagccaaaacagtgtgtgttagcaagcaagttaccactgtgggtaactggagcttaatctcccccgggaatgtcagagtcaatgtagaacatgcaactcagaattatcccacagggggcaggggaattacagtattgatacatcaacacccatcagtcattggttaagggttgcttaggaagggacatattaattctcgggcacttttgacctcccctgcacatgggcttgcttttcttttcttttttttcttttctttttttttttttttgagaccgagtttcactcttgtcacccaggctggagtacaatggcacaatctcggctccccacaacctccaccttcctggttcaagcgattctcctgcctcagccttcctgagtagctgggattacaggcatgtgccaccacgcctggctaattttgtatttttaatagagacagggtttctccatgctggtcaggctggtctcgaactccagacctcaggtgatccacccgccttggcctcccaaagtgctgggattacaggtgtaagccaccgtgctggcaggcttttcttttcaaagaaaattttcaaactgagtgatgcagatgctggcattgaaagttgagtctatgttccttataatggtaaggacaaggggattatggacatagcatctgatcccagcactgattaaaaacagcttgtttttccaaccattatgaaatgtaattttttttttttttgagctggagtctcgctctgttgcccaggctggagtgcagtggcacaatcttggctcactgcaaagtccgcctcctgggttcaagcaattctcctgcctcagcctcccgagtagctgggattacaggcacccgccaccacacccagctaatttttgtatttttttttagtagagacggtttcaccatgttggccaggctggtctggaactcctgacctcaggtgatccgcttgcctcggcctcccaaagtgctgagattacgggcatgagccactgcgcctggacgaaatgtaatacttttttgtgttagtatatggtgtaaaaaaataagattcaaatggctactacacagtattttctaggaaagctaattttaaattgataacaggttttataatttttatcatctttgctgtcaatatcatcacctgtacaccttcataagtgccagataaagaactgtgctatgtaaactcaagcagaaatgataactttaacctaaaagcttacatgaaatgctgctccaatgttgctaaggtctgtgatatatttgctagagaaagctttaatgaaatttggaacttgctttgcatttatattttattctgtgtgatttttctgtttttaatacaaacattttctaggggtccatacttaactgtccaacctctatatcggccctacaaacagcaaaatcaagttaaatttctgggtcgtcgatccaagcaagctcaaatgaaagttgaaaaaatgagaaaagtttatttggctaaagaaaaaaatacttctgaggtgactgtaagtttaacttgtactgaattcattgttttggacaatattcaaactgtctgtaaagtagctgtacttacgtaaatgaaattttcctaatctaaagttcaaggctgaaacacatttgacacatttatcataggtagtataaagtgaatttcatcttggtaacattttttaaaaaattcttaatattggtggcaattctgataaaaaccagctgttttggctccatatcagcatgagttggcaaaaaaattattttctctgtatgttgacactgttgattcagcacatctctgatggtggttttttcaaaatggaagtcatttctatctaaacttattaagaactatgctttataaagtctgcctcagtatacttttacatcataggaatttacaacagacatgtattcatgttattactttgtaatttaaaaaatcgctgtgaatattttgagatgaggataaatatagtcaaacattaaaatataaagtagtaaaaaccaaatatataacacttcctacttttattgataattctgcctaggaaccaaaaacgggcccatcaggtacaaaggataactatcatctccactccatcttttgacattgtgaaaactaaggaatctatgtcagagtgtcagctggaaaaagaaaaaaggactcattttcctggtatcaaaacttggcagctggtgattctccatcatgataatgaacagttaattgacagaaaaccaaagttgtttaacaatctgcttgtctgtctataaataatgagtatgtgtaataaaggaaaataacatagaataagtcctgagtatgctctcttaactaaatgtgtgacatattttaagcctttttgaattgccataggaacaaattcttttactgacagaattttaatctaaacaaattttttctattagatgcccttgaactagcagtatacagttttgtttaagagattagtccctgggacttttattcgattttgattttccttcatttaaacaaatatctgaacaggccatacttagcataaatattagaattcacagaatgaaaggctccttttgagtcagcttctagtgtcttttttaaagttgaaattcatttttacagaacagcttgtgaatgacctattctgaatgataataaaagtaataatggatttattgctacaggaggcatgacatggcataactaatcactattgagcattggaagcacctgagacagaatgttgcgtctgctttaatctattttggatatttttcaagtatgaagtctatttggagtaatatttatcaatttcattttcaattgataaattgtcattcctaatatggtataaattattgatttcttttgtgatccaggctgttggattatatcaaactttacacagaggctatgataattaaactgcaataatttattgaactttaaagatccaatttttaattttacttaacatttaaaacgtgtaggttgattgctgatctaattcaggcatggcaacctataaaaggatctcattctctgctaaaatattctcttacatgatgaagaatattggagtaaatgtgtatgattctcactggaatatatttaacataaatgttcactctttgatattaatgcattgtcatttgatattcaaaaatggaatgataagccccttgttttcagagcttgtactggacactggttgaatggaaaaacagctatttgtcctcatgagtcacacatgttttcatgcattaatttgggatgtagtctctcatctgatcaaatgcatatcagactctatctatagtgtgtgtaataacaaaggaagattttaggtagcaagatggagggaaaagacaaaggaaggacatactctttatgtttcaggattcccatttctcatatttcattagctataactttgtctcatcgtaacacctagctccaagagaggctgggaaatgtatttttgtttggggcatttatgtacccaactaaaattctgttgtcataaaagaaatggtagtggatattaaggcacaactagcttctgctcccagagatcatgtcttctatcaattcttttaactcacattaaataatataaccacatcaccgaaaatccttttaaaagtaaaattacacataatcccatcaccataatataacaactgttttcatttgcttatacctttctaatctgtctaaatgcacacatatttttcacatagttgtaataatagctaacatatagatttaaacttttcacatatgttttttttgtttgtttttttttttttgagacggagctatgctcttgttgcccaggctggagtgcaatggtgcgatcacagctcactgcaacctccgcctactgagttcaagcgattctcctgcctcagcctcctgagcagctgggattacaggcatgcgccacccgcctggctaattttgtatttttagtagagacagggtttctccatgttggtcaggctggtctcgaactcccgacctcaggtgatcacccgccttggcctcccaaagtgcttggattacaggggtgagacaccatgcccggtcacttttcgcttatatcttaaacatgatccacttaaaaataatttaatgggtatacaatagcccattgaattgataaagcataatttatctagccatactcatatcattggatatttcagttgtttctaattttttactactataggtaattaacattagaatgaacattttcatacatagtcttcttttggttatttttctgttatttatttttagcctaattgcactataatcggagagtatgatttgtatgatactgattctgggaaacttgttgatacttgctttatagccaagtacattgtccattttcataaatgtttcttgtactcttaagaaaaaatgtgcatccggctagacgaggtggctcaagtgatcctcccacctcagcttcccaaagtgctggaattataggcatgagccaccactcctggtccctttattcctaataatgcattttgcttggaagactgtttttttttttttttttttttttttttttttgagatggagtcttgctctgtcacccaggctggagagcagtggctcaatctcagctcactgcaacctccgcctcctgggttcgagcgattctccttgctagcctcccgagtagccgggatcacaggcatgcgccaccatacccagctaatttttcaaaatatttttagtagaggcagggtttcaccattttggccaggctggtctcgaactcctgacctcaggtgatccacctgcctcagcctcccagagtgctgggattacaggcgtgagccaccacgcccggctggaagactattttgtctcatgtgaacagagctactctagcgttcttctggttagtgtctgcctggcatatccctttccatcttttaaaatgttcaaccttttcatgtatcagagactggctagatgctcactgacttcattttctcttcctgagaacacatttcccaacattttttgcagctatgttgggaccctgtgaactgacttctggctagaggaatgtgagcagaagtgatgtataccacttctagccttggcccctaaaataaacgtggtcttctattctccctctcccctccctctcgttcctgtggctggaggcaaagaactccatggtggtagaagcaggattgaaggattccggattcctgtcactgaaggagagacagccagagcagcagcctgacttgctgaactgtaatgtgagtgagaaataaactttgtgtgttaagtcccaataatcctaggagttatttgctacaacagataacattaatcattctgatataatgtcaaatacactgtctttgtgttttaggttttctctaggatactgcaaatatctagattgtttttgttttaattcaatcccaggacatctttaactggtgagtttaattcatttacactttattgcaattttaattaattgctaacatatttggaattatttttaccattttattttgtgctatctctcctgcattttctttgtctttcccctgccattcctgttttctttcagatttcaattctacatttttccccctactattttggaagttatacactctgggtttgttgttgttgtttttgagatggagtctctctttgtcacccaggctggagtgtagtggctcgatctcagctcactgcaacctccgcctcccaggttcgagcaattctccttcctagcctccggagtagctgggatcacaggcatgtgccaccatgcacagctaatttttaaaaatatttttagtggaggcagggtttcaccatgttggccaggctggtctcgatctcctggcctcaagcgatcctcctgcctcaacctcccaaagtgccaggattacaggcatgagccatcgcgcctggccgactctgtttttattcttactgattatgtgtaaattatggcacgcgtacttaaaatctaaagttaatcaatagctccactctcctcccaaactaagaatgctaatcaccatccttttgtcttacaggttattgctatatctaatattttagcactatcttgtttttaacttccaacttagatattattattgttaatctcagactttccttctgagatcatttttctttatcctgatgtatattcttaaaagctcctttaaggagcatcttttggtaataattactctttcagtttttgattttctgaaaatgtcctcattttgcccctattcttaaatatgtaatttaggtaggtatcaaattctacattggctatggttttctcttagcaacgcaaagtcttgttccactgtcttctggctgctgcctccagtctaattgttattccttttaaatgatctcttttttttctctgacaactttgaagatgttctctttgtattttgtgtttctcagttatagtgaagaagatttaccctcccatgtgctttctctatttccattgctttttaccttactgtcctttgagtgtctgactttacgtagaggtctcattttcaaccccctaccttccctgagcacaagagcttgtcttctacacacctgaggtcattaaaatccaaaactcggccgggcgcagtggtggctcatgcctgtaatcccagcactttgggaggctgaggcgggtggatcacctgaggtcaggagtttgagaccagcctaaccaacatggtgaaaccccgtctctactaaaatacaaaaattagccaggcgtggtggcgagcacctgtaatcccacctactcaggaggctgaggcgggagaatcgcttgaacccaggaggcagagtttgcagtgagccgagattgtgccattgcacagcctgggcaacaggagagaaactgcattaaaaaaaaaaaaacccgaaacttcaggtccctggtgttgacacacatgctcagggcttcagtcatttaccatgctagtgtgtagctttctctttatttttcactcctgaggatttttccttcttacaagctcagttatgccttttaaaagatgtttttgcattttatctagaatttctatggtttttacaatgggttagtttttttcaggatatttggtctactgatttctcataagccagagtccatgttgtcacttcattatgttgaattatagccttaggctaaaatcttgagagtggcactacttacatcagagactttaaacatttttatagctgtttatatgcattgtcatattgcttttcagccgtttgctctttgagtggtatgatactgatgtttgtttatacttcatggaggcagagtgctatgatagagtatgggctttgaatctgccaaatttggttctctttctccctatcgtcatctctccctcaacccctccattatttacatatttagagattagagaaaattttttccttaaacgttttgttgtggtttgaaatgtgagagaattaagaaagaaggtgccatttgagagggagagaaggaagatacatgtaggagaacttctggctaaaaatgctggcttgagcatcgaagtctctttcccccttcaaaccccactgcaataacagtaaggagatttttttttagagcctaaaccttgatgataaagagaaatcagagaaaacagtagcaacattttgtcagttagaaagcttacaaatgagtgctggttgaatagcagatctgagaaaactgagttttaaactggtgttgaaaaaaagctaagaaacaaatcagtttacactgggggaaccccctagaagactcaggaattggcaacagcaggtaacctttggaagtgaggggtgaagtagaaggagttggttgaaaatctgtttaagaagcagttacagcaccaaatcccttccccactgttatgggttgaattgtgactaccccgccacctctcatccccccaaccctcttctgaaaaaatatgttgaagtcctaacccccagtactttagaatgtgaccttatttggagatagggttgttgcagatgtaattcattaagatgaggtcatactagaatacgctgggcccctaatccaatatgactgttgtccttataagaagacagccatgtaaaaacaaagacccacagggagaacaccatgtaatgatgaagagactgaagtcatgcagctgcaagccaagggatgtcaaagattgccagcaaaccaccacaaactacacagaggcagggaaagagtctcctttgcaggtttcagggggagcatggccctgcagacaccttgatcttggacttctagcctccagaactgtgagacaatgaatttctattgtgttaagtcatccactttggagtattttgttactgcaaatacctaggagactaatataaccaccttgcagtcaggcaactgcttctccttcactcgggccaaaaccggagactttttttttgtctagagagagcaaaacaaaagttctctgaactggaaaacataagggacagctaggggccaaggtactgtcctgagaacaggggttaagcaaaagttgacatattgaatgttgagactcctgccttcttctcccaccaggcactcaaaatgctggccgttagggttacaccctccatgaaatttagaagagacttctctggagagtctggccaacaagggaaaagacttcaaaatactggtatgaagggagtcttacaactaatggcccaactaggcagggaagcttatagccccctagttccacccaactacacagagcctccaatcttgtttttttggcgccccactcataaataagcacagatggccgggcatggtggctcacaccagtaatcccagcactttgggaggccgaggtgggtggatcacctgaggtcaggagttcaagaccaacctggccaacatggtaaaaccccgtctctactaaaaattcaaaaaattagccagatgtggtggcacgtgcctgtagtcccagctactcgggaggctgaggcacaagaatcacttgaacctgggagatggaggttgcagtgagctgagatcatgccactgcactccagcctgggtgacagagtgagactccatctcaaaaaaataaataaaataataagaaataagcacagacaaccacccatcactggacatctgaagaaagcttgtagcatgaaagacagaggagcaaacagaggagaaaacttgaaggaaataaatgatccaaatatagaaacctcaaaaaaaaaaaaaaaaacagaccactaataagatataagaaaatatactgcattcatgaaataagaacagcatggttggccaggcgcggtggctcacacttgtaatcccagcactttgggaggccaaggcgggtggatcacctgaggttgggagttcgagaccagcctgacgaacacggagaaaccccgtctctactagaaacacaaaattagctgggcatggtggtgcatgcctgtaatcccagctactcgggaggctgaggcaggagaatcacttgaacccgggaggtggtggttgcggtgagctgagatcactccattgcactccagcctggtcaaccagcaaaactccatctcaaaaaagaaaagaaaagaaaagaaaaaagaacagcatggttatatgtatgtgtgtgtatgaagattctaatcgttttgcattttaaagcctcaaaggtttgaatttaaagttaaggaagtcaaggccgggcacggtggctcatacttgtcatcccagcactttgggaggccgaggcaggtgg
